United States Patent
Widmaier et al.

(10) Patent No.: US 9,963,554 B2
(45) Date of Patent: *May 8, 2018

(54) METHODS AND COMPOSITIONS FOR SYNTHESIZING IMPROVED SILK FIBERS

(71) Applicant: Bolt Threads, Inc., Emeryville, CA (US)

(72) Inventors: Daniel M. Widmaier, San Francisco, CA (US); David N. Breslauer, San Francisco, CA (US); Joshua Kittleson, Berkeley, CA (US); Brendan Turner, El Cerrito, CA (US); Lindsay Wray, Fairfield, CA (US)

(73) Assignee: Bolt Threads, Inc., Emeryville, CA (US)

(*) Notice: Subject to any disclaimer, the term of this patent is extended or adjusted under 35 U.S.C. 154(b) by 0 days. days.

This patent is subject to a terminal disclaimer.

(21) Appl. No.: 15/073,514

(22) Filed: Mar. 17, 2016

(65) Prior Publication Data
US 2016/0222174 A1    Aug. 4, 2016

Related U.S. Application Data

(63) Continuation of application No. PCT/US2014/056117, filed on Sep. 17, 2014.

(60) Provisional application No. 61/878,858, filed on Sep. 17, 2013.

(51) Int. Cl.
| | |
|---|---|
| C12P 21/02 | (2006.01) |
| C07H 1/00 | (2006.01) |
| C08H 1/00 | (2006.01) |
| D01F 4/00 | (2006.01) |
| D01F 4/02 | (2006.01) |
| D01F 6/68 | (2006.01) |
| C07K 14/435 | (2006.01) |
| C12P 21/00 | (2006.01) |

(52) U.S. Cl.
CPC ......... *C08H 1/00* (2013.01); *C07K 14/43518* (2013.01); *C07K 14/43586* (2013.01); *C12P 21/00* (2013.01); *C12P 21/02* (2013.01); *D01F 4/00* (2013.01); *D01F 4/02* (2013.01); *D01F 6/68* (2013.01); *C07K 2319/02* (2013.01)

(58) Field of Classification Search
None
See application file for complete search history.

(56) References Cited

U.S. PATENT DOCUMENTS

| | | | |
|---|---|---|---|
| 5,171,505 A | 12/1992 | Lock | |
| 7,057,023 B2 | 6/2006 | Islam et al. | |
| 2005/0010035 A1 | 1/2005 | Lewis et al. | |
| 2005/0054830 A1 | 3/2005 | Islam et al. | |
| 2007/0260039 A1 | 11/2007 | Karatzas et al. | |
| 2010/0068517 A1 | 3/2010 | Liu et al. | |
| 2010/0222553 A1 | 9/2010 | Hayashi et al. | |
| 2012/0041177 A1 | 2/2012 | Johansson et al. | |
| 2013/0109762 A1 | 5/2013 | Lammel et al. | |
| 2013/0212718 A1 | 8/2013 | Fraser et al. | |
| 2014/0058066 A1 | 2/2014 | Sekiyama et al. | |
| 2014/0128991 A1 | 5/2014 | Atanasoska et al. | |
| 2014/0194603 A1 | 7/2014 | Lehmann et al. | |
| 2015/0047532 A1 | 2/2015 | Lewis et al. | |

FOREIGN PATENT DOCUMENTS

| | | |
|---|---|---|
| WO | WO 02/099082 A2 | 12/2002 |
| WO | WO 03/020916 A2 | 3/2003 |
| WO | WO 2003/057727 A1 | 7/2003 |
| WO | WO 2012/050919 A2 | 4/2012 |
| WO | WO 2012/055854 A2 | 5/2012 |
| WO | WO 2013/180767 A2 | 12/2013 |
| WO | WO 2016/149414 A1 | 9/2016 |

OTHER PUBLICATIONS

Hopp et al., Nature Biotechnology, 6:1204-1210, 1988.*
Collins, T. et al., "Batch Production of a Silk-Elastin-Like Protein in E. col. BL21(DE3): Key Parameters for Optimisation," Microbial Cell Factories, Feb. 27, 2013, pp. 1-16, vol. 12, No. 21.
Elices, M. et al., "Bioinspired Fibers Follow the Track of Natural Spider Silk." Macromolecules, 2011, pp. 1166-1176, vol. 44.
Guerette, P.A. et al., "Silk Properties Determined by Gland-Specific Expression of a Spider Fibroin Gene Family." Science, Apr. 5, 1996, pp. 112-115, vol. 272, No. 5258.
Paal, M. et al., "A Novel Ecotin-Ubiquitin-Tag (ECUT) for Efficient, Soluble Peptide Production in the Periplasm of *Escherichia coli*," Microbial Cell Factories, Jan. 21, 2009, pp. 1-9, vol. 8, No. 7.
PCT Invitation to Pay Additional Fees, PCT Application No. PCT/US14/56117, dated Jan. 14, 2015, 3 pages.
PCT International Search Report and Written Opinion, PCT Application No. PCT/US14/56117, dated Mar. 10, 2015, 26 pages.
Xia, X. et al., "Native-Sized Recombinant Spider Silk Protein Produced in Metabolically Engineered *Escherichia coli* Results in a Strong Fiber," Proc. Natl. Acad. Sci., 2010, pp. 14059-14063, vol. 107, No. 32.
PCT International Search Report and Written Opinion, PCT Application No. PCT/US16/22707, dated Jul. 12, 2016, 17 pages.
European Extended Search Report, European Application No. 14846179.1, dated Feb. 24, 2017, 11 pages.
Database Accession No. I6YNT3, "SubName: Full=Major Ampullate Silk Protein 2 {ECO:0000313| ENBL:AFN54363.1}," Retrieved from EBI Accession No. UNIPROT:I6YNT3, Oct. 3, 2012, 1 page.

(Continued)

*Primary Examiner* — Nancy A Treptow

(74) *Attorney, Agent, or Firm* — Fenwick & West LLP

(57) ABSTRACT

The present disclosure provides methods and compositions for directed to synthetic block copolymer proteins, expression constructs for their secretion, recombinant microorganisms for their production, and synthetic fibers (including advantageously, microfibers) comprising these proteins that recapitulate many properties of natural silk. The recombinant microorganisms can be used for the commercial production of silk-like fibers.

11 Claims, 21 Drawing Sheets

(56) References Cited

OTHER PUBLICATIONS

Zhang, Y. et al., "The Molecular Structures of Major Ampullate Silk Proteins of the Wasp Spider, *Argiope bruennichi*: A Second Blueprint for Synthesizing De Novo Silk," Comparative Biochemistry and Physiology Part B: Biochemistry and Molecular Biology, Elsevier, Dec. 20, 2012, pp. 151-158, vol. 164, No. 3.
Bliven, S. et al., "Circular Permutation in Proteins," PLOS Computational Biology, Mar. 2012, pp. 1-5, vol. 8, Issue 3, e1002445.

\* cited by examiner

METHODS AND COMPOSITIONS FOR SYNTHESIZING IMPROVED SILK FIBERS

CROSS-REFERENCE TO RELATED APPLICATIONS

This application is a continuation of co-pending International Application No. PCT/US2014/056117, filed Sep. 17, 2014, which claims benefit of U.S. Provisional Application No. 61/878,858, filed on Sep. 17, 2013, both of which are hereby incorporated by reference in their entirety for all purposes.

SEQUENCE LISTING

The instant application contains a Sequence Listing which has been submitted electronically in ASCII format and is hereby incorporated by reference in its entirety. Said ASCII copy, created on Sep. 16, 2014, is named 27321PCT_CRF_SequenceListing.txt and is 4,189,730 bytes in size.

FIELD OF THE INVENTION

The present disclosure relates to methods and compositions directed to synthetic block copolymer proteins, expression constructs for their secretion, recombinant microorganisms for their production, and synthetic fibers comprising these proteins that recapitulate many properties of natural silk.

BACKGROUND OF THE INVENTION

Spider's silk polypeptides are large (>150 kDa, >1000 amino acids) polypeptides that can be broken down into three domains: an N-terminal non-repetitive domain (NTD), the repeat domain (REP), and the C-terminal non-repetitive domain (CTD). The NTD and CTD are relatively small (~150, ~100 amino acids respectively), well-studied, and are believed to confer to the polypeptide aqueous stability, pH sensitivity, and molecular alignment upon aggregation. NTD also has a strongly predicted secretion tag, which is often removed during heterologous expression. The repetitive region composes ~90% of the natural polypeptide, and folds into the crystalline and amorphous regions that confer strength and flexibility to the silk fiber, respectively.

Silk polypeptides come from a variety of sources, including bees, moths, spiders, mites, and other arthropods. Some organisms make multiple silk fibers with unique sequences, structural elements, and mechanical properties. For example, orb weaving spiders have six unique types of glands that produce different silk polypeptide sequences that are polymerized into fibers tailored to fit an environmental or lifecycle niche. The fibers are named for the gland they originate from and the polypeptides are labeled with the gland abbreviation (e.g. "Ma") and "Sp" for spidroin (short for spider fibroin). In orb weavers, these types include Major Ampullate (MaSp, also called dragline), Minor Ampullate (MiSp), Flagelliform (Flag), Aciniform (AcSp), Tubuliform (TuSp), and Pyriform (PySp). This combination of polypeptide sequences across fiber types, domains, and variation amongst different genus and species of organisms leads to a vast array of potential properties that can be harnessed by commercial production of the recombinant fibers. To date, the vast majority of the work with recombinant silks has focused on the Major Ampullate Spidroins (MaSp).

Currently, recombinant silk fibers are not commercially available and, with a handful of exceptions, are not produced in microorganisms outside of *Escherichia coli* and other gram-negative prokaryotes. Recombinant silks produced to date have largely consisted either of polymerized short silk sequence motifs or fragments of native repeat domains, sometimes in combination with NTDs and/or CTDs. This has resulted in the production of small scales of recombinant silk polypeptides (milligrams at lab scale, kilograms at bioprocessing scale) produced using intracellular expression and purification by chromatography or bulk precipitation. These methods do not lead to viable commercial scalability that can compete with the price of existing technical and textile fibers. Additional production hosts that have been utilized to make silk polypeptides include transgenic goats, transgenic silkworms, and plants. These hosts have yet to enable commercial scale production of silk, presumably due to slow engineering cycles and poor scalability.

Microfibers are a classification of fibers having a fineness of less than 1 decitex (dtex), approximately 10 µm in diameter. H. K., Kaynak and O. Babaarslan, Woven Fabrics, Croatia: InTech, 2012. The small diameter of microfibers imparts a range of qualities and characteristics to microfiber yarns and fabrics that are desirable to consumers. Microfibers are inherently more flexible (bending is inversely proportional to fiber diameter) and thus have a soft feel, low stiffness, and high drapeability. Microfibers can also be spun into yarns having high fiber density (greater fibers per yarn cross-sectional area), giving microfiber yarns a higher strength compared to other yarns of similar dimensions. Microfibers also contribute to discrete stress relief within the yarn, resulting in anti-wrinkle fabrics. Furthermore, microfibers have high compaction efficiency within the yarn, which improves fabric waterproofness and windproofness while maintaining breathability compared to other waterproofing and windproofing techniques (such as polyvinyl coatings). The high density of fibers within microfiber fabrics results in microchannel structures between fibers, which promotes the capillary effect and imparts a wicking and quick drying characteristic. The high surface area to volume of microfiber yarns allows for brighter and sharper dyeing, and printed fabrics have clearer and sharper pattern retention as well. Currently, recombinant silk fibers do not have a fineness that is small enough to result in silks having microfiber type characteristics. U.S. Pat. App. Pub. No. 2014/0058066 generally discloses fiber diameters between 5-100 µm, but does not actually disclose any working examples of any fiber having a diameter as small as 5 µm.

What is needed, therefore, are improved methods and compositions relating to of recombinant block copolymer proteins, expression constructs for their secretion at high rates, microorganisms expressing these proteins and synthetic fibers made from these proteins that recapitulate many of the properties of silk fibers, including fibers having small diameters useful for microfiber textiles.

SUMMARY OF THE INVENTION

The invention provides compositions of proteinaceous block co-polymers capable of assembling into fibers, and methods of producing said co-polymers. A proteinaceous block co-polymer comprises a quasi-repeat domain, the co-polymer capable of assembling into a fiber. In some embodiments the co-polymer comprises an alanine composition of 12-40% of the amino acid sequence of the co-polymer, a glycine composition of 25-50% of the amino acid sequence of the co-polymer, a proline composition of 9-20% of the amino acid sequence of the co-polymer, a β-turn composition of 15-37% of the amino acid sequence of the co-polymer, a GPG amino acid motif content of 18-55% of the amino acid sequence of the co-polymer, and a poly alanine amino acid motif content of 9-35% of all amino acids of the co-polymer.

In some embodiments, the co-polymer also includes an N-terminal non-repetitive domain between 75-350 amino acids in length, and a C-terminal non-repetitive domain between 75-350 amino acids in length. In some embodiments, the quasi-repeat domain is 500-5000, 119-1575, or 900-950 amino acids in length. In other embodiments, the mass of the co-polymer is 40-400, 12.2-132, or 70-100 kDa. In some embodiments, the alanine composition is 16-31% or 15-20% of the amino acid sequence of the co-polymer. In other embodiments, the glycine composition is 29-43% or 38-43% of the amino acid sequence of the co-polymer. In some embodiments, the proline composition is 11-16% or 13-15% of the amino acid sequence of the co-polymer. In other embodiments, the β-turn composition is 18-33% or 25-30% of the amino acid sequence of the co-polymer. In some embodiments, the GPG amino acid motif content is 22-47% or 30-45% of the amino acid sequence of the co-polymer. In other embodiments, the poly alanine amino acid motif content is 12-29% of the amino acid sequence of the co-polymer. In some embodiments, the co-polymer comprises a sequence from Table 13a, SEQ ID NO: 1396, or SEQ ID NO: 1374. In other embodiments, the co-polymer consists of SEQ ID NO: 1398 or SEQ ID NO: 2770.

In some embodiments, an engineered microorganism comprises a heterologous nucleic acid molecule encoding a secretion signal and a coding sequence, the coding sequence encoding the co-polymer described above, wherein the secretion signal allows for secretion of the co-polymer from the microorganism. In further embodiments, the engineered microorganism is *Pichia pastoris* or *Bacillus subtilis*. In other embodiments, a cell culture comprises a culture medium and the engineered microorganism. In other embodiments, a method of producing a secreted block co-polymer comprises obtaining the cell culture medium and maintaining the cell culture medium under conditions that result in the engineered microorganism secreting the co-polymer at a rate of at least 2-20 mg silk/g DCW/hour. In further embodiments, the co-polymer is secreted at a rate of at least 20 mg silk/g DCW/hour. In yet other embodiments, a cell culture medium comprises a secreted co-polymer as described above.

In other embodiments, the invention includes a method for producing a fiber comprises obtaining the cell culture medium as described above, isolating the secreted protein, and processing the protein into a spinnable solution and producing a fiber from the spinnable solution. In some embodiments, a fiber comprises a secreted co-polymer as described above. In some embodiments, the fiber has a yield stress of 24-172 or 150-172 MPa. In other embodiments, the fiber has a maximum stress of 54-310 or 150-310 MPa. In some embodiments, the fiber has a breaking strain of 2-200% or 180-200%. In other embodiments, the fiber has a diameter of 4.48-12.7 or 4-5 µm. In some embodiments, the fiber has an initial modulus of 1617-5820 or 5500-5820 MPa. In other embodiments, the fiber has a toughness value of at least 0.5, 3.1, or 59.2 MJ/m$^3$. In still other embodiments, the fiber has a fineness between 0.2-0.6 denier.

These and other embodiments of the invention are further described in the Figures, Description, Examples and Claims, herein.

BRIEF DESCRIPTION OF THE FIGURES

FIG. 1 discloses "AAAAAA" as SEQ ID NO: 2838.

FIG. 8 discloses SEQ ID NOs: 2839-2842 and 2841-2843, respectively, in order of appearance.

DETAILED DESCRIPTION OF THE INVENTION

Figure 1:
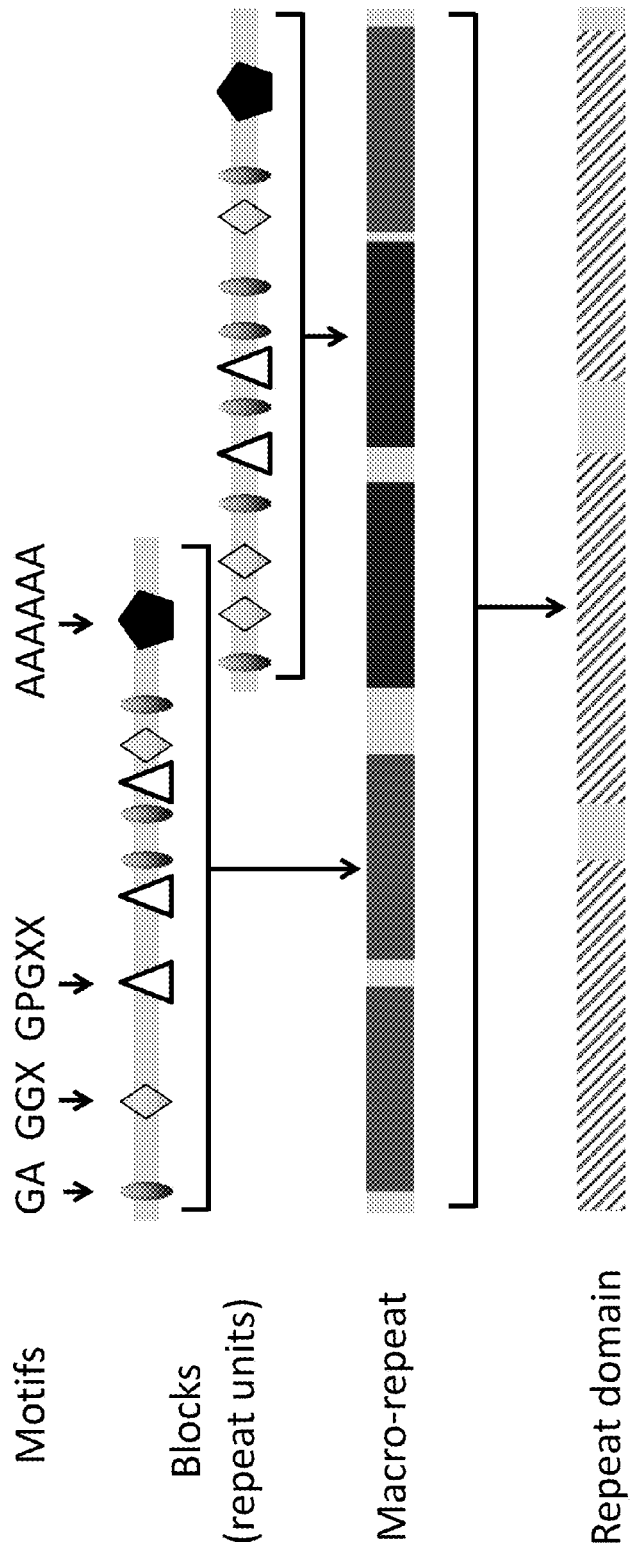
FIG. 1 depicts the hierarchical architecture of silk polypeptide sequences, including the block copolymeric structure of natural silk polypeptides.

Unless otherwise defined herein, scientific and technical terms used in connection with the present invention shall have the meanings that are commonly understood by those of ordinary skill in the art. Further, unless otherwise required by context, singular terms shall include the plural and plural terms shall include the singular. Generally, nomenclatures used in connection with, and techniques of, biochemistry, enzymology, molecular and cellular biology, microbiology, genetics and polypeptide and nucleic acid chemistry and hybridization described herein are those well known and commonly used in the art.

The methods and techniques of the present invention are generally performed according to conventional methods well known in the art and as described in various general and more specific references that are cited and discussed throughout the present specification unless otherwise indicated. See, e.g., Sambrook et al., *Molecular Cloning: A Laboratory Manual*, 2d ed., Cold Spring Harbor Laboratory Press, Cold Spring Harbor, N.Y. (1989); Ausubel et al., *Current Protocols in Molecular Biology*, Greene Publishing Associates (1992, and Supplements to 2002); Harlow and Lane, *Antibodies: A Laboratory Manual*, Cold Spring Harbor Laboratory Press, Cold Spring Harbor, N.Y. (1990); Taylor and Drickamer, *Introduction to Glycobiology*, Oxford Univ. Press (2003); *Worthington Enzyme Manual*, Worthington Biochemical Corp., Freehold, N.J.; *Handbook of Biochemistry: Section A Proteins*, Vol I, CRC Press (1976); Handbook of Biochemistry: Section A Proteins, Vol II, CRC Press (1976); *Essentials of Glycobiology*, Cold Spring Harbor Laboratory Press (1999).

All publications, patents and other references mentioned herein are hereby incorporated by reference in their entireties.

The following terms, unless otherwise indicated, shall be understood to have the following meanings:

The term "polynucleotide" or "nucleic acid molecule" refers to a polymeric form of nucleotides of at least 10 bases in length. The term includes DNA molecules (e.g., cDNA or genomic or synthetic DNA) and RNA molecules (e.g., mRNA or synthetic RNA), as well as analogs of DNA or RNA containing non-natural nucleotide analogs, non-native internucleoside bonds, or both. The nucleic acid can be in any topological conformation. For instance, the nucleic acid can be single-stranded, double-stranded, triple-stranded, quadruplexed, partially double-stranded, branched, hairpinned, circular, or in a padlocked conformation.

Unless otherwise indicated, and as an example for all sequences described herein under the general format "SEQ ID NO:", "nucleic acid comprising SEQ ID NO:1" refers to a nucleic acid, at least a portion of which has either (i) the sequence of SEQ ID NO:1, or (ii) a sequence complementary to SEQ ID NO:1. The choice between the two is dictated by the context. For instance, if the nucleic acid is used as a probe, the choice between the two is dictated by the requirement that the probe be complementary to the desired target.

An "isolated" RNA, DNA or a mixed polymer is one which is substantially separated from other cellular components that naturally accompany the native polynucleotide in its natural host cell, e.g., ribosomes, polymerases and genomic sequences with which it is naturally associated.

The term "recombinant" refers to a biomolecule, e.g., a gene or polypeptide, that (1) has been removed from its naturally occurring environment, (2) is not associated with all or a portion of a polynucleotide in which the gene is found in nature, (3) is operatively linked to a polynucleotide which it is not linked to in nature, or (4) does not occur in nature. The term "recombinant" can be used in reference to cloned DNA isolates, chemically synthesized polynucleotide analogs, or polynucleotide analogs that are biologically synthesized by heterologous systems, as well as polypeptides and/or mRNAs encoded by such nucleic acids.

As used herein, an endogenous nucleic acid sequence in the genome of an organism (or the encoded polypeptide product of that sequence) is deemed "recombinant" herein if a heterologous sequence is placed adjacent to the endogenous nucleic acid sequence, such that the expression of this endogenous nucleic acid sequence is altered. In this context, a heterologous sequence is a sequence that is not naturally adjacent to the endogenous nucleic acid sequence, whether or not the heterologous sequence is itself endogenous (originating from the same host cell or progeny thereof) or exogenous (originating from a different host cell or progeny thereof). By way of example, a promoter sequence can be substituted (e.g., by homologous recombination) for the native promoter of a gene in the genome of a host cell, such that this gene has an altered expression pattern. This gene would now become "recombinant" because it is separated from at least some of the sequences that naturally flank it. In an embodiment, a heterologous nucleic acid molecule is not endogenous to the organism. In further embodiments, a heterologous nucleic acid molecule is a plasmid or molecule integrated into a host chromosome by homologous or random integration.

A nucleic acid is also considered "recombinant" if it contains any modifications that do not naturally occur to the corresponding nucleic acid in a genome. For instance, an endogenous coding sequence is considered "recombinant" if it contains an insertion, deletion or a point mutation introduced artificially, e.g., by human intervention. A "recombinant nucleic acid" also includes a nucleic acid integrated into a host cell chromosome at a heterologous site and a nucleic acid construct present as an episome.

As used herein, the phrase "degenerate variant" of a reference nucleic acid sequence encompasses nucleic acid sequences that can be translated, according to the standard genetic code, to provide an amino acid sequence identical to that translated from the reference nucleic acid sequence. The term "degenerate oligonucleotide" or "degenerate primer" is used to signify an oligonucleotide capable of hybridizing with target nucleic acid sequences that are not necessarily identical in sequence but that are homologous to one another within one or more particular segments.

The term "percent sequence identity" or "identical" in the context of nucleic acid sequences refers to the residues in the two sequences which are the same when aligned for maximum correspondence. The length of sequence identity comparison may be over a stretch of at least about nine nucleotides, usually at least about 20 nucleotides, more usually at least about 24 nucleotides, typically at least about 28 nucleotides, more typically at least about 32 nucleotides, and preferably at least about 36 or more nucleotides. There are a number of different algorithms known in the art which can be used to measure nucleotide sequence identity. For instance, polynucleotide sequences can be compared using FASTA, Gap or Bestfit, which are programs in Wisconsin Package Version 10.0, Genetics Computer Group (GCG), Madison, Wis. FASTA provides alignments and percent sequence identity of the regions of the best overlap between the query and search sequences. Pearson, Methods Enzymol. 183:63-98 (1990) (hereby incorporated by reference in its entirety). For instance, percent sequence identity between nucleic acid sequences can be determined using FASTA with its default parameters (a word size of 6 and the NOPAM factor for the scoring matrix) or using Gap with its default parameters as provided in GCG Version 6.1, herein incorporated by reference. Alternatively, sequences can be compared using the computer program, BLAST (Altschul et al., J. Mol. Biol. 215:403-410 (1990); Gish and States, Nature Genet. 3:266-272 (1993); Madden et al., Meth. Enzymol. 266:131-141 (1996); Altschul et al., Nucleic Acids Res. 25:3389-3402 (1997); Zhang and Madden, Genome Res. 7:649-656 (1997)), especially blastp or tblastn (Altschul et al., Nucleic Acids Res. 25:3389-3402 (1997)).

The term "substantial homology" or "substantial similarity," when referring to a nucleic acid or fragment thereof, indicates that, when optimally aligned with appropriate nucleotide insertions or deletions with another nucleic acid (or its complementary strand), there is nucleotide sequence identity in at least about 76%, 80%, 85%, preferably at least about 90%, and more preferably at least about 95%, 96%, 97%, 98% or 99% of the nucleotide bases, as measured by any well-known algorithm of sequence identity, such as FASTA, BLAST or Gap, as discussed above.

The nucleic acids (also referred to as polynucleotides) of this present invention can include both sense and antisense strands of RNA, cDNA, genomic DNA, and synthetic forms and mixed polymers of the above. They can be modified chemically or biochemically or may contain non-natural or derivatized nucleotide bases, as will be readily appreciated by those of skill in the art. Such modifications include, for example, labels, methylation, substitution of one or more of the naturally occurring nucleotides with an analog, internucleotide modifications such as uncharged linkages (e.g., methyl phosphonates, phosphotriesters, phosphoramidates, carbamates, etc.), charged linkages (e.g., phosphorothioates, phosphorodithioates, etc.), pendent moieties (e.g., polypeptides), intercalators (e.g., acridine, psoralen, etc.), chelators, alkylators, and modified linkages (e.g., alpha anomeric nucleic acids, etc.) Also included are synthetic molecules that mimic polynucleotides in their ability to bind to a designated sequence via hydrogen bonding and other chemical interactions. Such molecules are known in the art and include, for example, those in which peptide linkages substitute for phosphate linkages in the backbone of the molecule. Other modifications can include, for example, analogs in which the ribose ring contains a bridging moiety or other structure such as the modifications found in "locked" nucleic acids.

The term "mutated" when applied to nucleic acid sequences means that nucleotides in a nucleic acid sequence may be inserted, deleted or changed compared to a reference nucleic acid sequence. A single alteration may be made at a locus (a point mutation) or multiple nucleotides may be inserted, deleted or changed at a single locus. In addition, one or more alterations may be made at any number of loci within a nucleic acid sequence. A nucleic acid sequence may be mutated by any method known in the art including but not limited to mutagenesis techniques such as "error-prone PCR" (a process for performing PCR under conditions where the copying fidelity of the DNA polymerase is low, such that a high rate of point mutations is obtained along the entire length of the PCR product; see, e.g., Leung et al., Technique, 1:11-15 (1989) and Caldwell and Joyce, PCR Methods Applic. 2:28-33 (1992)); and "oligonucleotide-directed mutagenesis" (a process which enables the generation of site-specific mutations in any cloned DNA segment of interest; see, e.g., Reidhaar-Olson and Sauer, Science 241:53-57 (1988)).

The term "vector" as used herein is intended to refer to a nucleic acid molecule capable of transporting another nucleic acid to which it has been linked. One type of vector is a "plasmid," which generally refers to a circular double stranded DNA loop into which additional DNA segments may be ligated, but also includes linear double-stranded molecules such as those resulting from amplification by the polymerase chain reaction (PCR) or from treatment of a circular plasmid with a restriction enzyme. Other vectors include cosmids, bacterial artificial chromosomes (BAC) and yeast artificial chromosomes (YAC). Another type of vector is a viral vector, wherein additional DNA segments may be ligated into the viral genome (discussed in more detail below). Certain vectors are capable of autonomous replication in a host cell into which they are introduced (e.g., vectors having an origin of replication which functions in the host cell). Other vectors can be integrated into the genome of a host cell upon introduction into the host cell, and are thereby replicated along with the host genome. Moreover, certain preferred vectors are capable of directing the expression of genes to which they are operatively linked. Such vectors are referred to herein as "recombinant expression vectors" (or simply "expression vectors").

The term "expression system" as used herein includes vehicles or vectors for the expression of a gene in a host cell as well as vehicles or vectors which bring about stable integration of a gene into the host chromosome.

"Operatively linked" or "operably linked" expression control sequences refers to a linkage in which the expression control sequence is contiguous with the gene of interest to control the gene of interest, as well as expression control sequences that act in trans or at a distance to control the gene of interest.

The term "expression control sequence" as used herein refers to polynucleotide sequences which are necessary to affect the expression of coding sequences to which they are operatively linked. Expression control sequences are sequences which control the transcription, post-transcriptional events and translation of nucleic acid sequences. Expression control sequences include appropriate transcription initiation, termination, promoter and enhancer sequences; efficient RNA processing signals such as splicing and polyadenylation signals; sequences that stabilize cytoplasmic mRNA; sequences that enhance translation efficiency (e.g., ribosome binding sites); sequences that enhance polypeptide stability; and when desired, sequences that enhance polypeptide secretion. The nature of such control sequences differs depending upon the host organism; in prokaryotes, such control sequences generally include promoter, ribosomal binding site, and transcription termination sequence. The term "control sequences" is intended to include, at a minimum, all components whose presence is essential for expression, and can also include additional components whose presence is advantageous, for example, leader sequences and fusion partner sequences.

The term "promoter," as used herein, refers to a DNA region to which RNA polymerase binds to initiate gene transcription, and positions at the 5' direction of an mRNA transcription initiation site.

The term "recombinant host cell" (or simply "host cell"), as used herein, is intended to refer to a cell into which a recombinant vector has been introduced. It should be understood that such terms are intended to refer not only to the particular subject cell but to the progeny of such a cell. Because certain modifications may occur in succeeding generations due to either mutation or environmental influences, such progeny may not, in fact, be identical to the parent cell, but are still included within the scope of the term "host cell" as used herein. A recombinant host cell may be an isolated cell or cell line grown in culture or may be a cell which resides in a living tissue or organism.

The term "peptide" as used herein refers to a short polypeptide, e.g., one that is typically less than about 50 amino acids long and more typically less than about 30 amino acids long. The term as used herein encompasses analogs and mimetics that mimic structural and thus biological function.

The term "polypeptide" encompasses both naturally-occurring and non-naturally-occurring proteins, and fragments, mutants, derivatives and analogs thereof. A polypeptide may be monomeric or polymeric. Further, a polypeptide may comprise a number of different domains each of which has one or more distinct activities.

As used herein, the term "molecule" means any compound, including, but not limited to, a small molecule, peptide, polypeptide, sugar, nucleotide, nucleic acid, polynucleotide, lipid, etc., and such a compound can be natural or synthetic.

The term "block" or "repeat unit" as used herein refers to a subsequence greater than approximately 12 amino acids of a natural silk polypeptide that is found, possibly with modest variations, repeatedly in said natural silk polypeptide sequence and serves as a basic repeating unit in said silk polypeptide sequence. Examples can be found in Table 1. Further examples of block amino acid sequences can be found in SEQ ID NOs: 1515-2156. Blocks may, but do not necessarily, include very short "motifs." A "motif" as used herein refers to an approximately 2-10 amino acid sequence that appears in multiple blocks. For example, a motif may consist of the amino acid sequence GGA, GPG, or AAAAA (SEQ ID NO: 2803). A sequence of a plurality of blocks is a "block co-polymer."

As used herein, the term "repeat domain" refers to a sequence selected from the set of contiguous (unbroken by a substantial non-repetitive domain, excluding known silk spacer elements) repetitive segments in a silk polypeptide. Native silk sequences generally contain one repeat domain. In some embodiments of the present invention, there is one repeat domain per silk molecule. A "macro-repeat" as used herein is a naturally occurring repetitive amino acid sequence comprising more than one block. In an embodiment, a macro-repeat is repeated at least twice in a repeat domain. In a further embodiment, the two repetitions are imperfect. A "quasi-repeat" as used herein is an amino acid sequence comprising more than one block, such that the blocks are similar but not identical in amino acid sequence.

A "repeat sequence" or "R" as used herein refers to a repetitive amino acid sequence. Examples include the nucleotide sequences of SEQ ID NOs: 1-467, the nucleotide sequences with flanking sequences for cloning of SEQ ID NOs: 468-931, and the amino acid sequences of SEQ ID NOs: 932-1398. In an embodiment, a repeat sequence includes a macro-repeat or a fragment of a macro-repeat. In another embodiment, a repeat sequence includes a block. In a further embodiment, a single block is split across two repeat sequences.

Any ranges disclosed herein are inclusive of the extremes of the range. For example, a range of 2-5% includes 2% and 5%, and any number or fraction of a number in between, for example: 2.25%, 2.5%, 2.75%, 3%, 3.25%, 3.5%, 3.75%, 4%, 4.25%, 4.5%, and 4.75%.

Unless otherwise defined, all technical and scientific terms used herein have the same meaning as commonly understood by one of ordinary skill in the art to which this present invention pertains. Exemplary methods and materials are described below, although methods and materials similar or equivalent to those described herein can also be used in the practice of the present invention and will be apparent to those of skill in the art. All publications and other references mentioned herein are incorporated by reference in their entirety. In case of conflict, the present specification, including definitions, will control. The materials, methods, and examples are illustrative only and not intended to be limiting.

Throughout this specification and claims, the word "comprise" or variations such as "comprises" or "comprising," will be understood to imply the inclusion of a stated integer or group of integers but not the exclusion of any other integer or group of integers.

Silk Sequences

In some embodiments disclosed herein are 1) block copolymer polypeptide compositions generated by mixing and matching repeat domains derived from silk polypeptide sequences and 2) recombinant expression of block copolymer polypeptides having sufficiently large size (approximately 40 kDa) to form useful fibers by secretion from an industrially scalable microorganism. We provide herein the ability to produce relatively large (approximately 40 kDa to approximately 100 kDa) block copolymer polypeptides engineered from silk repeat domain fragments in a scalable engineered microorganism host, including sequences from almost all published amino acid sequences of spider silk polypeptides. In some embodiments, silk polypeptide sequences are matched and designed to produce highly expressed and secreted polypeptides capable of fiber formation.

Provided herein, in several embodiments, are compositions for expression and secretion of block copolymers engineered from a combinatorial mix of silk polypeptide domains across the silk polypeptide sequence space. In some embodiments provided herein are methods of secreting block copolymers in scalable organisms (e.g., yeast, fungi, and gram positive bacteria). In some embodiments, the block copolymer polypeptide comprises 0 or more N-terminal domains (NTD), 1 or more repeat domains (REP), and 0 or more C-terminal domains (CTD). In some aspects of the embodiment, the block copolymer polypeptide is >100 amino acids of a single polypeptide chain. In some embodiments, the block copolymer polypeptide comprises a domain that is at least 80%, 81%, 82%, 83%, 84%, 85%, 86%, 87%, 88%, 89%, 90%, 91%, 92%, 93%, 94%, 95%, 96%, 97%, 98%, or 99% identical to a sequence of SEQ ID NOs: 932-1398.

Several types of native spider silks have been identified. The mechanical properties of each natively spun silk type are believed to be closely connected to the molecular composition of that silk. See, e.g., Garb, J. E., et al., Untangling spider silk evolution with spidroin terminal domains, *BMC Evol. Biol.*, 10:243 (2010); Bittencourt, D., et al., Protein families, natural history and biotechnological aspects of spider silk, *Genet. Mol. Res.*, 11:3 (2012); Rising, A., et al., Spider silk proteins: recent advances in recombinant production, structure-function relationships and biomedical applications, *Cell. Mol. Life Sci.*, 68:2, pg. 169-184 (2011); and Humenik, M., et al., Spider silk: understanding the structure-function relationship of a natural fiber, *Prog. Mol. Biol. Transl. Sci.*, 103, pg. 131-85 (2011). For example:

Aciniform (AcSp) silks tend to have high toughness, a result of moderately high strength coupled with moderately high extensibility. AcSp silks are characterized by large block ("ensemble repeat") sizes that often incorporate motifs of poly serine and GPX. Tubuliform (TuSp or Cylindrical) silks tend to have large diameters, with modest strength and high extensibility. TuSp silks are characterized by their poly serine and poly threonine content, and short tracts of poly alanine. Major Ampullate (MaSp) silks tend to have high strength and modest extensibility. MaSp silks can be one of two subtypes: MaSp1 and MaSp2. MaSp1 silks are generally less extensible than MaSp2 silks, and are characterized by poly alanine, GX, and GGX motifs. MaSp2 silks are characterized by poly alanine, GGX, and GPX motifs. Minor Ampullate (MiSp) silks tend to have modest strength and modest extensibility. MiSp silks are characterized by GGX, GA, and poly A motifs, and often contain spacer elements of approximately 100 amino acids. Flagelliform (Flag) silks tend to have very high extensibility and modest strength. Flag silks are usually characterized by GPG, GGX, and short spacer motifs.

The properties of each silk type can vary from species to species, and spiders leading distinct lifestyles (e.g. sedentary web spinners vs. vagabond hunters) or that are evolutionarily older may produce silks that differ in properties from the above descriptions (for descriptions of spider diversity and classification, see Hormiga, G., and Griswold, C. E., Systematics, phylogeny, and evolution of orb-weaving spiders, *Annu. Rev. Entomol.* 59, pg. 487-512 (2014); and Blackedge, T. A. et al., Reconstructing web evolution and spider diversification in the molecular era, *Proc. Natl. Acad. Sci. U.S.A.*, 106:13, pg. 5229-5234 (2009)). However, synthetic block copolymer polypeptides having sequence similarity and/or amino acid composition similarity to the repeat domains of native silk proteins can be used to manufacture on commercial scales consistent silk-like fibers that recapitulate the properties of corresponding natural silk fibers.

In some embodiments, a list of putative silk sequences can be compiled by searching GenBank for relevant terms, e.g. "spidroin" "fibroin" "MaSp", and those sequences can be pooled with additional sequences obtained through independent sequencing efforts. Sequences are then translated into amino acids, filtered for duplicate entries, and manually split into domains (NTD, REP, CTD). In some embodiments, candidate amino acid sequences are reverse translated into a DNA sequence optimized for expression in *Pichia (Komagataella) pastoris*. The DNA sequences are each cloned into an expression vector and transformed into *Pichia (Komagataella) pastoris*. In some embodiments, various silk domains demonstrating successful expression and secretion are subsequently assembled in combinatorial fashion to build silk molecules capable of fiber formation.

Silk polypeptides are characteristically composed of a repeat domain (REP) flanked by non-repetitive regions (e.g., C-terminal and N-terminal domains). In an embodiment, both the C-terminal and N-terminal domains are between 75-350 amino acids in length. The repeat domain exhibits a hierarchical architecture, as depicted in FIG. 1. The repeat domain comprises a series of blocks (also called repeat units). The blocks are repeated, sometimes perfectly and sometimes imperfectly (making up a quasi-repeat domain), throughout the silk repeat domain. The length and composition of blocks varies among different silk types and across different species. Table 1 lists examples of block sequences from selected species and silk types, with further examples presented in Rising, A. et al., Spider silk proteins: recent advances in recombinant production, structure-function relationships and biomedical applications, *Cell Mol. Life Sci.*, 68:2, pg 169-184 (2011); and Gatesy, J. et al., Extreme diversity, conservation, and convergence of spider silk fibroin sequences, *Science,* 291:5513, pg. 2603-2605 (2001). In some cases, blocks may be arranged in a regular pattern, forming larger macro-repeats that appear multiple times (usually 2-8) in the repeat domain of the silk sequence. Repeated blocks inside a repeat domain or macro-repeat, and repeated macro-repeats within the repeat domain, may be separated by spacing elements. In some embodiments, block sequences comprise a glycine rich region followed by a polyA region. In some embodiments, short (~1-10) amino acid motifs appear multiple times inside of blocks. A subset of commonly observed motifs is depicted in FIG. 1. For the purpose of this invention, blocks from different natural silk polypeptides can be selected without reference to circular permutation (i.e., identified blocks that are otherwise similar between silk polypeptides may not align due to circular permutation). Thus, for example, a "block" of SGAGG (SEQ ID NO: 2804) is, for the purposes of the present invention, the same as GSGAG (SEQ ID NO: 2805) and the same as GGSGA (SEQ ID NO: 2806); they are all just circular permutations of each other. The particular permutation selected for a given silk sequence can be dictated by convenience (usually starting with a G) more than anything else. Silk sequences obtained from the NCBI database can be partitioned into blocks and non-repetitive regions.

TABLE 1

Samples of Block Sequences

| Species | Silk Type | Representative Block Amino Acid Sequence |
|---|---|---|
| *Aliatypus gulosus* | Fibroin 1 | GAASSSSTIITTKSASASAAADASAAATASAASRSSAN AAASAFAQSFSSILLESGYFCSIFGSSISSSYAAAIASAA SRAAAESNGYTTHAYACAKAVASAVERVTSGADAY AYAQAISDALSHALLYTGRLNTANANSLASAFAYAF ANAAAQASASSASAGAASASGAASASGAGSAS (SEQ ID NO: 2807) |
| *Plectreurys tristis* | Fibroin 1 | GAGAGAGAGAGAGAGAGSGASTSVSTSSSSGSGAGA GAGSGAGSGAGAGSGAGAGAGGAGAGFGSGLGL GYGVGLSSAQAQAQAQAAAQAQAQAQAQAYAAAQ AQAQAQAQAQAAAAAAAAAAA (SEQ ID NO: 2808) |
| *Plectreurys tristis* | Fibroin 4 | GAAQKQPSGESSVATASAAATSVTSGGAPVGKPGVP APIFYPQGPLQQGPAPGPSNVQPGTSQQGPIGGVGGS NAFSSSFASALSLNRGFTEVISSASATAVASAFQKGLA PYGTAFALSAASAAADAYNSIGSGANAFAYAQAFAR VLYPLVQQYGLSSSAKASAFASAIASSFSSGTSGQGPS IGQQQPPVTISAASASAGASAAAVGGGQVGQGPYGG QQQSTAASASAAAATATS (SEQ ID NO: 2809) |

TABLE 1-continued

Samples of Block Sequences

| Species | Silk Type | Representative Block Amino Acid Sequence |
|---|---|---|
| Araneus gemmoides | TuSp | GNVGYQLGLKVANSLGLGNAQALASSLSQAVSAVG VGASSNAYANAVSNAVGQVLAGQGILNAANAGSLA SSFASALSSSAASVASQSASQSQAASQSQAAASAFRQ AASQSASQSDSRAGSQSSTKTTSTSTSGSQADSRSASS SASQSASAFAQQSSASLSSSSSFSSAFSSATSISAV (SEQ ID NO: 2810) |
| Argiope aurantia | TuSp | GSLASSFASALSASAASVASSAAAQAASQSQAAASAF SRAASQSASQSAARSGAQSISTTTTTSTAGSQAASQSA SSAASQSASSFARASSASLAASSSFSSAFSSANSLSAL GNVGYQLGFNVANNLGIGNAAGLGNALSQAVSSVG VGASSSTYANAVSNAVGQFLAGQGILNAANA (SEQ ID NO: 2811) |
| Deinopis spinosa | TuSp | GASASAYASAISNAVGPYLYGLGLFNQANAASFASSF ASAVSSAVASASASAASSAYAQSAAAQAQAASSAFS QAAAQSAAAASAGASAGASAGAGAVAGAGAVA GAGAVAGASAAAASQAAASSSASAVASAFAQSASY ALASSSAFANAFASATSAGYLGSLAYQLGLTTAYNL GLSNAQAFASTLSQAVTGVGL (SEQ ID NO: 2812) |
| Nephila clavipes | TuSp | GATAASYGNALSTAAAQFFATAGLLNAGNASALASS FARAFSASAESQSFAQSQAFQQASAFQQAASRSASQS AAEAGSTSSSTTTTTSAARSQAASQSASSSYSSAFAQA ASSSLATSSALSRAFSSVSSASAASSLAYSIGLSAARSL GIADAAGLAGVLARAAGALGQ (SEQ ID NO: 2813) |
| Argiope trifasciata | Flag | GGAPGGGPGGAGPGGAGFGPGGGAGFGPGGGAGFG PGGAAGGPGGPGGPGGPGGAGGYGPGGAGGYGPGG VGPGGAGGYGPGGAGGYGPGGSGPGGAGPGGAGGE GPVTVDVDVTVGPEGVGGGPGGAGPGGAGFGPGGG AGFGPGGAPGAPGGPGGPGGPGGPGGPGGVGPGGA GGYGPGGAGGVGPAGTGGFGPGGAGGFGPGGAGGF GPGGAGGFGPAGAGGYGPGGVGPGGAGGFGPGGVG PGGSGPGGAGGEGPVTVDVDVSV (SEQ ID NO: 2814) |
| Nephila clavipes | Flag | GVSYGPGGAGGPYGPGGPYGPGGEGPGGAGGPYGP GGVGPGGSGPGGYGPGGAGPGGYGPGGSGPGGYGP GGSGPGGYGPGGSGPGGYGPGGSGPGGYGPGGYGP GGSGPGGSGPGGSGPGGYGPGGTGPGGSGPGGYGPG GSGPGGSGPGGYGPGGSGPGGFGPGGSGPGGYGPGG SGPGGAGPGGVGPGGFGPGGAGPGGAAPGGAGPGG AGPGGAGPGGAGPGGAGPGGAGGAGGAGGS GGAGGSGGTTIIEDLDITIDGADGPITISEELPISGAGGS GPGGAGPGGVGPGGSGPGGVGPGGSGPGGVGPGGS GPGGVGPGGAGGPYGPGGSGPGGAGGAGGPGGAYG PGGSYGPGGSGPGGAGGPYGPGGEGPGGAGGPYGP GGAGGPYGPGGAGGPYGPGGEGGPYGP (SEQ ID NO: 2815) |
| Latrodectus hesperus | AcSp | GINVDSDIGSVTSLILSGSTLQMTIPAGGDDLSGGYPG GFPAGAQPSGGAPVDFGGPSAGGDVAAKLARSLAST LASSGVFRAAFNSRVSTPVAVQLTDALVQKIASNLGL DYATASKLRKASQAVSKVRMGSDTNAYALAISSALA EVLSSSGKVADANINQIAPQLASGIVLGVSTTAPQFGV DLSSINVNLDISNVARNMQASIQGGPAPITAEGPDFGA GYPGGAPTDLSGLDMGAPSDGSRGGDATAKLLQAL VPALLKSDVFRAIYKRGTRKQVVQYVTNSALQQAAS SLGLDASTISQLQTKATQALSSVSADSDSTAYAKAFG LAIAQVLGTSGQVNDANVNQIGAKLATGILRGSSAV APRLGIDLS (SEQ ID NO: 2816) |
| Argiope trifasciata | AcSp | GAGYTGPSGPSTGPSGYPGPLGGGAPFGQSGFGGSAG PQGGFGATGGASAGLISRVANALANTSTLRTVLRTG VSQQIASSVVQRAAQSLASTLGVDGNNLARFAVQAV SRLPAGSDTSAYAQAFSSALFNAGVLNASNIDTLGSR VLSALLNGVSSAAQGLGINVDSGSVQSDISSSSSFLST SSSSASYSQASASSTS (SEQ ID NO: 2817) |
| Uloborus diversus | AcSp | GASAADIATAIAASVATSLQSNGVLTASNVSQLSNQL ASYVSSGLSSTASSLGIQLGASLGAGFGASAGLSASTD ISSSVEATSASTLSSSASSTSVVSSINAQLVPALAQTAV LNAAFSNINTQNAIRIAELLTQQVGRQYGLSGSDVAT ASSQIRSALYSVQQGSASSAYVSAIVGPLITALSSRGV VNASNSSQIASSLATAILQFTANVAPQFGISIPTSAVQS |

TABLE 1-continued

Samples of Block Sequences

| Species | Silk Type | Representative Block Amino Acid Sequence |
|---|---|---|
| | | DLSTISQSLTAISSQTSSSVDSSTSAFGGISGPSGPSYG PQPSGPTFGPGPSLSGLTGFTATFASSFKSTLASSTQFQ LIAQSNLDVQTRSSLISKVLINALSSLGISASVASSIAAS SSQSLLSVSA (SEQ ID NO: 2818) |
| Euprosthenops australis | MaSp1 | GGQGGQGQGRYGQGAGSSAAAAAAAAAAAAAA (SEQ ID NO: 2819) |
| Tetragnatha kauaiensis | MaSp1 | GGLGGGQGAGQGGQQGAGQGGYGSGLGGAGQGAS AAAAAAAA (SEQ ID NO: 2820) |
| Argiope aurantia | MaSp2 | GGYGPGAGQQGPGSQGPGSGGQQGPGGLGPYGPSA AAAAAAA (SEQ ID NO: 2821) |
| Deinopis spinosa | MaSp2 | GPGGYGGPGQQGPGQGQYGPGTGQQGQGPSGQQGP AGAAAAAAAA (SEQ ID NO: 2822) |
| Nephila clavata | MaSp2 | GPGGYGLGQQGPGQQGPGQQGPAGYGPSGLSGPGG AAAAAAA (SEQ ID NO: 2823) |

Figure 2:
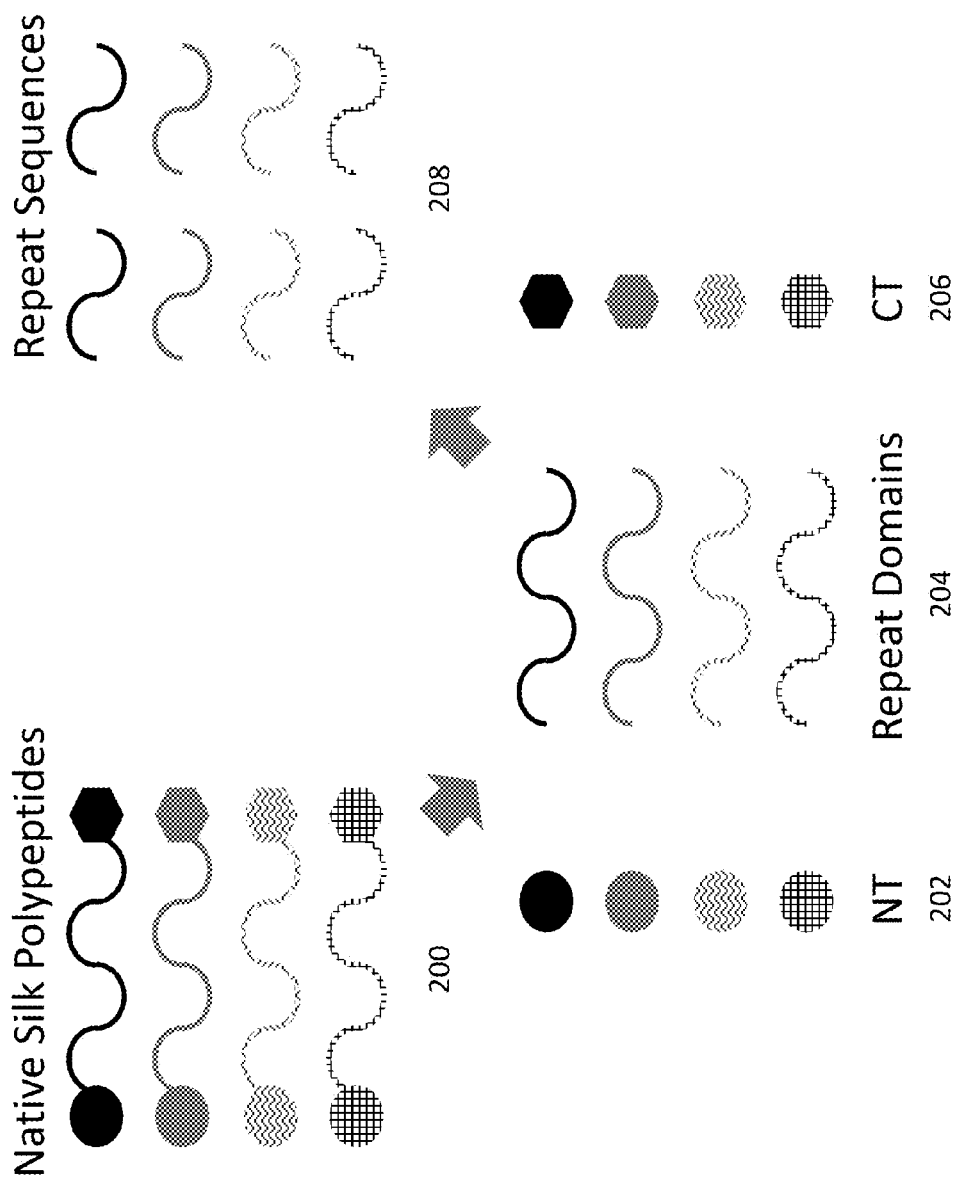
FIG. 2 shows a screening process for silk polypeptide domains and their DNA encoding according to some embodiments of the invention.
Figure 3:
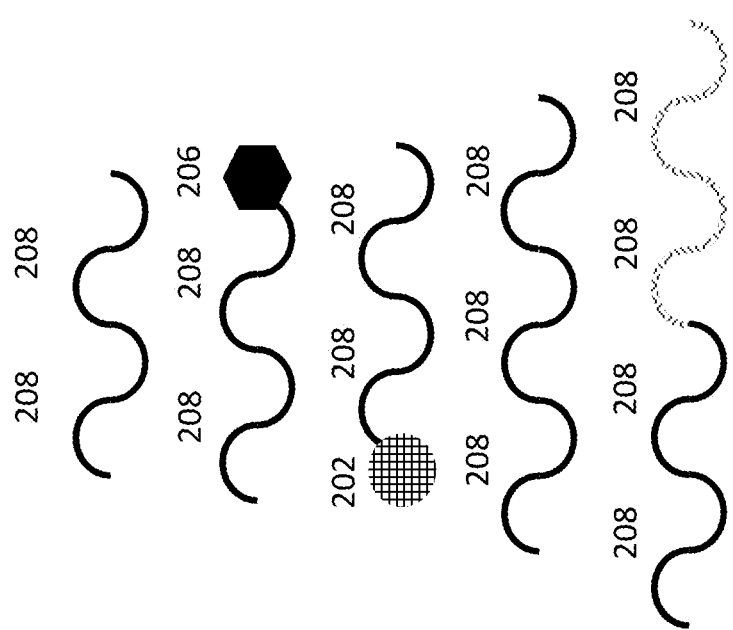
FIG. 3 shows how silk repeat sequences and terminal domains that pass preliminary screening are assembled to create functional block copolymers that can be purified and made into fibers, according to an embodiment of the invention.

The construction of fiber-forming block copolymer polypeptides from the blocks and/or macro-repeat domains, according to certain embodiments of the invention, is shown in FIGS. 2 and 3. FIG. 2 illustrates the division of silk sequences into distinct domains. Natural silk sequences 200 obtained from a protein database such as GenBank or through de novo sequencing are broken up by domain (N-terminal domain 202, repeat domain 204, and C-terminal domain 206). The N-terminal domain 202 and C-terminal domain 206 sequences selected for the purpose of synthesis and assembly into fibers include natural amino acid sequence information and other modifications described herein. The repeat domain 204 is decomposed into repeat sequences 208 containing representative blocks, usually 1-8 depending upon the type of silk, that capture critical amino acid information while reducing the size of the DNA encoding the amino acids into a readily synthesizable fragment. FIG. 3 illustrates how select NT 202, CT 206, and repeat sequences 208 can be assembled to create block copolymer polypeptides that can be purified and made into fibers that recapitulate the functional properties of silk, according to an embodiment of the invention. Individual NT, CT, and repeat sequences that have been verified to express and secrete are assembled into functional block copolymer polypeptides. In some embodiments, a properly formed block copolymer polypeptide comprises at least one repeat domain comprising at least 1 repeat sequence 208, and is optionally flanked by an N-terminal domain 202 and/or a C-terminal domain 206.

In some embodiments, a repeat domain comprises at least one repeat sequence. In some embodiments, the repeat sequence, N-terminal domain sequence, and/or C-terminal domain sequence is selected from SEQ ID NOs: 932-1398. In some embodiments, the repeat sequence is 150-300 amino acid residues. In some embodiments, the repeat sequence comprises a plurality of blocks. In some embodiments, the repeat sequence comprises a plurality of macro-repeats. In some embodiments, a block or a macro-repeat is split across multiple repeat sequences.

In some embodiments, the repeat sequence starts with a Glycine, and cannot end with phenylalanine (F), tyrosine (Y), tryptophan (W), cysteine (C), histidine (H), asparagine (N), methionine (M), or aspartic acid (D) to satisfy DNA assembly requirements. In some embodiments, some of the repeat sequences can be altered as compared to native sequences. In some embodiments, the repeat sequences can be altered such as by addition of a serine to the C terminus of the polypeptide (to avoid terminating in F, Y, W, C, H, N, M, or D). In some embodiments, the repeat sequence can be modified by filling in an incomplete block with homologous sequence from another block. In some embodiments, the repeat sequence can be modified by rearranging the order of blocks or macrorepeats.

In some embodiments, non-repetitive N- and C-terminal domains can be selected for synthesis (See SEQ ID NOs: 1-145). In some embodiments, N-terminal domains can be by removal of the leading signal sequence, e.g., as identified by SignalP (Peterson, T. N., et. Al., SignalP 4.0: discriminating signal peptides from transmembrane regions, *Nat. Methods*, 8:10, pg. 785-786 (2011).

In some embodiments, the N-terminal domain, repeat sequence, or C-terminal domain sequences can be derived from *Agelenopsis aperta, Aliatypus gulosus, Aphonopelma seemanni, Aptostichus* sp. AS217, *Aptostichus* sp. AS220, *Araneus diadematus, Araneus gemmoides, Araneus ventricosus, Argiope amoena, Argiope argentata, Argiope bruennichi, Argiope trifasciata, Atypoides riversi, Avicularia juruensis, Bothriocyrtum californicum, Deinopis Spinosa, Diguetia canities, Dolomedes tenebrosus, Euagrus chisoseus, Euprosthenops australis, Gasteracantha mammosa, Hypochilus thorelli, Kukulcania hibernalis, Latrodectus hesperus, Megahexura fulva, Metepeira grandiosa, Nephila antipodiana, Nephila clavata, Nephila clavipes, Nephila madagascariensis, Nephila pilipes, Nephilengys cruentata, Parawixia bistriata, Peucetia viridans, Plectreurys tristis, Poecilotheria regalis, Tetragnatha kauaiensis,* or *Uloborus diversus*.

In some embodiments, the silk polypeptide nucleotide coding sequence can be operatively linked to an alpha mating factor nucleotide coding sequence. In some embodiments, the silk polypeptide nucleotide coding sequence can be operatively linked to another endogenous or heterologous secretion signal coding sequence. In some embodiments, the silk polypeptide nucleotide coding sequence can be operatively linked to a 3× FLAG nucleotide coding sequence. In some embodiments, the silk polypeptide nucleotide coding sequence is operatively linked to other affinity tags such as 6-8 His residues (SEQ ID NO: 2824).

Expression Vectors

The expression vectors of the present invention can be produced following the teachings of the present specification in view of techniques known in the art. Sequences, for example vector sequences or sequences encoding transgenes, can be commercially obtained from companies such as Integrated DNA Technologies, Coralville, Iowa or DNA 2.0, Menlo Park, Calif. Exemplified herein are expression vectors that direct high-level expression of the chimeric silk polypeptides.

Another standard source for the polynucleotides used in the invention is polynucleotides isolated from an organism (e.g., bacteria), a cell, or selected tissue. Nucleic acids from the selected source can be isolated by standard procedures, which typically include successive phenol and phenol/chloroform extractions followed by ethanol precipitation. After precipitation, the polynucleotides can be treated with a restriction endonuclease which cleaves the nucleic acid molecules into fragments. Fragments of the selected size can be separated by a number of techniques, including agarose or polyacrylamide gel electrophoresis or pulse field gel electrophoresis (Care et al. (1984) Nuc. Acid Res. 12:5647-5664; Chu et al. (1986) Science 234:1582; Smith et al. (1987) Methods in Enzymology 151:461), to provide an appropriate size starting material for cloning.

Another method of obtaining the nucleotide components of the expression vectors or constructs is PCR. General procedures for PCR are taught in MacPherson et al., PCR: A PRACTICAL APPROACH, (IRL Press at Oxford University Press, (1991)). PCR conditions for each application reaction may be empirically determined. A number of parameters influence the success of a reaction. Among these parameters are annealing temperature and time, extension time, Mg2+ and ATP concentration, pH, and the relative concentration of primers, templates and deoxyribonucleotides. Exemplary primers are described below in the Examples. After amplification, the resulting fragments can be detected by agarose gel electrophoresis followed by visualization with ethidium bromide staining and ultraviolet illumination.

Another method for obtaining polynucleotides is by enzymatic digestion. For example, nucleotide sequences can be generated by digestion of appropriate vectors with suitable recognition restriction enzymes. Restriction cleaved fragments may be blunt ended by treating with the large fragment of E. coli DNA polymerase I (Klenow) in the presence of the four deoxynucleotide triphosphates (dNTPs) using standard techniques.

Polynucleotides are inserted into suitable backbones, for example, plasmids, using methods well known in the art. For example, insert and vector DNA can be contacted, under suitable conditions, with a restriction enzyme to create complementary or blunt ends on each molecule that can pair with each other and be joined with a ligase. Alternatively, synthetic nucleic acid linkers can be ligated to the termini of a polynucleotide. These synthetic linkers can contain nucleic acid sequences that correspond to a particular restriction site in the vector DNA. Other means are known and available in the art. A variety of sources can be used for the component polynucleotides.

In some embodiments, expression vectors containing an R, N, or C sequence are transformed into a host organism for expression and secretion. In some embodiments, the expression vectors comprise a secretion signal. In some embodiments, the expression vector comprises a terminator signal. In some embodiments, the expression vector is designed to integrate into a host cell genome and comprises: regions of homology to the target genome, a promoter, a secretion signal, a tag (e.g., a Flag tag), a termination/polyA signal, a selectable marker for Pichia, a selectable marker for E. coli, an origin of replication for E. coli, and restriction sites to release fragments of interest.

Host Cell Transformants

In some embodiments of the present invention, host cells transformed with the nucleic acid molecules or vectors of the present invention, and descendants thereof, are provided. In some embodiments of the present invention, these cells carry the nucleic acid sequences of the present invention on vectors, which may but need not be freely replicating vectors. In other embodiments of the present invention, the nucleic acids have been integrated into the genome of the host cells.

In some embodiments, microorganisms or host cells that enable the large-scale production of block copolymer polypeptides of the invention include a combination of: 1) the ability to produce large (>75 kDa) polypeptides, 2) the ability to secrete polypeptides outside of the cell and circumvent costly downstream intracellular purification, 3) resistance to contaminants (such as viruses and bacterial contaminations) at large-scale, and 4) the existing know-how for growing and processing the organism is large-scale (1-2000 m$^3$) bioreactors.

A variety of host organisms can be engineered/transformed to comprise a block copolymer polypeptide expression system. Preferred organisms for expression of a recombinant silk polypeptide include yeast, fungi, and gram-positive bacteria. In certain embodiments, the host organism is Arxula adeninivorans, Aspergillus aculeatus, Aspergillus awamori, Aspergillus ficuum, Aspergillus fumigatus, Aspergillus japonicus, Aspergillus nidulans, Aspergillus niger, Aspergillus oryzae, Aspergillus sojae, Aspergillus tubigensis, Bacillus alkalophilus, Bacillus amyloliquefaciens, Bacillus anthracia, Bacillus brevis, Bacillus circulans, Bacillus coagulans, Bacillus lautus, Bacillus lentus, Bacillus licheniformis, Bacillus methanolicus, Bacillus stearothermophilus, Bacillus subtilis, Bacillus thuringiensis, Candida boidinii, Chrysosporium lucknowense, Fusarium graminearum, Fusarium venenatum, Kluyveromyces lactis, Kluyveromyces marxianus, Myceliopthora thermophila, Neurospora crassa, Ogataea polymorpha, Penicillium camemberti, Penicillium canescens, Penicillium chrysogenum, Penicillium emersonii, Penicillium funiculosum, Penicillium griseoroseum, Penicillium purpurogenum, Penicillium roqueforti, Phanerochaete chrysosporium, Pichia angusta, Pichia methanolica, Pichia (Komagataella) pastoris, Pichia polymorpha, Pichia stipitis, Rhizomucor miehei, Rhizomucor pusillus, Rhizopus arrhizus, Streptomyces lividans, Saccharomyces cerevisiae, Schwanniomyces occidentalis, Trichoderma harzianum, Trichoderma reesei, or Yarrowia lipolytica.

In preferred aspects, the methods provide culturing host cells for direct product secretion for easy recovery without the need to extract biomass. In some embodiments, the block copolymer polypeptides are secreted directly into the medium for collection and processing.

Polypeptide Purification

The recombinant block copolymer polypeptides based on spider silk sequences produced by gene expression in a recombinant prokaryotic or eukaryotic system can be purified according to methods known in the art. In a preferred embodiment, a commercially available expression/secretion system can be used, whereby the recombinant polypeptide is expressed and thereafter secreted from the host cell, to be easily purified from the surrounding medium. If expression/secretion vectors are not used, an alternative approach involves purifying the recombinant block copolymer polypeptide from cell lysates (remains of cells following disruption of cellular integrity) derived from prokaryotic or eukaryotic cells in which a polypeptide was expressed. Methods for generation of such cell lysates are known to those of skill in the art. In some embodiments, recombinant block copolymer polypeptides are isolated from cell culture supernatant.

Recombinant block copolymer polypeptide may be purified by affinity separation, such as by immunological interaction with antibodies that bind specifically to the recombinant polypeptide or nickel columns for isolation of recombinant polypeptides tagged with 6-8 histidine residues at their N-terminus or C-terminus Alternative tags may comprise the FLAG epitope or the hemagglutinin epitope. Such methods are commonly used by skilled practitioners.

Additionally, the method of the present invention may preferably include a purification method, comprising exposing the cell culture supernatant containing expressed block copolymer polypeptides to ammonium sulphate of 5-60% saturation, preferably 10-40% saturation.

Spinning to Generate Fibers

In some embodiments, a solution of block copolymer polypeptide of the present invention is spun into fibers using elements of processes known in the art. These processes include, for example, wet spinning, dry-jet wet spinning, and dry spinning. In preferred wetspinning embodiments, the filament is extruded through an orifice into a liquid coagulation bath. In one embodiment, the filament can be extruded through an air gap prior to contacting the coagulation bath. In a dry-jet wet spinning process, the spinning solution is attenuated and stretched in an inert, non-coagulating fluid, e.g., air, before entering the coagulating bath. Suitable coagulating fluids are the same as those used in a wetspinning process.

Preferred coagulation baths for wet spinning are maintained at temperatures of 0-90° C., more preferably 20-60° C., and are preferably about 60%, 70%, 80%, 90%, or even 100% alcohol, preferably isopropanol, ethanol, or methanol. In a preferred embodiment, the coagulation bath is 85:15% by volume methanol:water. In alternate embodiments, coagulation baths comprise ammonium sulfate, sodium chloride, sodium sulfate, or other protein precipitating salts at temperature between 20-60° C. Certain coagulant baths can be preferred depending upon the composition of the dope solution and the desired fiber properties. For example, salt based coagulant baths are preferred for an aqueous dope solution. For example, methanol is preferred to produce a circular cross section fiber. Residence times in coagulation baths can range from nearly instantaneous to several hours, with preferred residence times lasting under one minute, and more preferred residence times lasting about 20 to 30 seconds. Residence times can depend on the geometry of the extruded fiber or filament. In certain embodiments, the extruded filament or fiber is passed through more than one coagulation bath of different or same composition. Optionally, the filament or fiber is also passed through one or more rinse baths to remove residual solvent and/or coagulant. Rinse baths of decreasing salt or alcohol concentration up to, preferably, an ultimate water bath, preferably follow salt or alcohol baths.

Following extrusion, the filament or fiber can be drawn. Drawing can improve the consistency, axial orientation and toughness of the filament. Drawing can be enhanced by the composition of a coagulation bath. Drawing may also be performed in a drawing bath containing a plasticizer such as water, glycerol or a salt solution. Drawing can also be performed in a drawing bath containing a crosslinker such as gluteraldehyde or formaldehyde. Drawing can be performed at temperature from 25-100° C. to alter fiber properties, preferably at 60° C. As is common in a continuous process, drawing can be performed simultaneously during the coagulation, wash, plasticizing, and/or crosslinking procedures described previously. Drawing rates depend on the filament being processed. In one embodiment, the drawing rate is preferably about 5x the rate of reeling from the coagulation bath.

In certain embodiments of the invention, the filament is wound onto a spool after extrusion or after drawing. Winding rates are generally 1 to 500 m/min, preferably 10 to 50 m/min.

In other embodiments, to enhance the ease with which the fiber is processed, the filament can be coated with lubricants or finishes prior to winding. Suitable lubricants or finishes can be polymers or wax finishes including but not limited to mineral oil, fatty acids, isobutyl-stearate, tallow fatty acid 2-ethylhexyl ester, polyol carboxylic acid ester, coconut oil fatty acid ester of glycerol, alkoxylated glycerol, a silicone, dimethyl polysiloxane, a polyalkylene glycol, polyethylene oxide, and a propylene oxide copolymer.

The spun fibers produced by the methods of the present invention can possess a diverse range of physical properties and characteristics, dependent upon the initial properties of the source materials, i.e., the dope solution, and the coordination and selection of variable aspects of the present method practiced to achieve a desired final product, whether that product be a soft, sticky, pliable matrix conducive to cellular growth in a medical application or a load-bearing, resilient fiber, such as fishing line or cable. The tensile strength of filaments spun by the methods of the present invention generally range from 0.2 g/denier (or g/(g/9000 m)) to 3 g/denier, with filaments intended for load-bearing uses preferably demonstrating a tensile strength of at least 2 g/denier. In an embodiment, the fibers have a fineness between 0.2-0.6 denier. Such properties as elasticity and elongation at break vary dependent upon the intended use of the spun fiber, but elasticity is preferably 5% or more, and elasticity for uses in which elasticity is a critical dimension, e.g., for products capable of being "tied," such as with sutures or laces, is preferably 10% or more. Water retention of spun fibers preferably is close to that of natural silk fibers, i.e., 10%. The diameter of spun fibers can span a broad range, dependent on the application; preferred fiber diameters range from 5, 10, 20, 30, 40, 50, 60 microns, but substantially thicker fibers may be produced, particularly for industrial applications (e.g., cable). The cross-sectional characteristics of spun fibers can vary; e.g., preferable spun fibers include circular cross-sections, elliptical, starburst cross-sections, and spun fibers featuring distinct core/sheath sections, as well as hollow fibers.

Example 1

Obtaining Silk Sequences

Silk sequences and partial sequences were obtained by searching NCBI's nucleotide database using the following terms to identify spider silks: MaSp, TuSp, CySp, MiSp, AcSp, Flag, major ampullate, minor ampullate, flagelliform, aciniform, tubuliform, cylindriform, spidroin, and spider fibroin. The resulting nucleotide sequences were translated into amino acid sequences, then curated to remove repeated sequences. Sequences that were less than 200-500 amino acids long, depending on the type of silk, were removed. Silk sequences from the above search were partitioned into blocks (e.g., repetitive sequences) and non-repetitive regions.

Repetitive polypeptide sequences (repeat (R) sequences) were selected from each silk sequence, and are listed as SEQ ID NOs: 1077-1393. Some of the R sequences have been altered, e.g., by addition of a serine to the C terminus to avoid terminating the sequence with an F, Y, W, C, H, N, M, or D amino acid. This allows for incorporation into the vector system described below. We also altered incomplete blocks by incorporation of segments from a homologous sequence from another block. For some sequences of SEQ ID NOs: 1077-1393, the order of blocks or macro-repeats has been altered from the sequence found in the NCBI database, and make up quasi-repeat domains Non-repetitive N terminal domain sequences (N sequences) and C terminal domain sequences (C sequences) were also selected from each silk sequence (SEQ ID NOs: 932-1076). The N terminal domain sequences were altered by removal of the leading signal sequence and, if not already present, addition of an N-terminal glycine residue.

A number of embodiments of the invention have been described. Nevertheless, it will be understood that various modifications may be made without departing from the spirit and scope of the invention.

Example 2

Reverse Translation of Silk Polypeptide Sequences to Nucleotide Sequences

R, N, and C amino acid sequences described in Example 1 were reverse translated to nucleotide sequences. To perform reverse translation, 10,000 candidate sequences were generated by using the *Pichia* (*Komagataella*) *pastoris* codon usage to bias random selection of a codon encoding the desired amino acid at each position. Select restriction sites (BsaI, BbsI, BtgZI, AscI, SbfI) were then removed from each sequence; if a site could not be removed, the sequence was discarded. Then, the entropy, longest repeated subsequence, and number of repeated 15-mers were each determined for each sequence.

To choose the optimal sequence to use for synthesis out of each set of 10,000, the following criteria were sequentially applied: keep the sequences with the lowest 25% of longest repeated subsequence, keep the sequences with the highest 10% of sequence entropy, and use the sequence with the lowest number of repeated 15-mers.

Example 3

Screening of Silk Polypeptides from Selected N, C, or R Sequences

The nucleotide sequences from Examples 1 and 2 were flanked with the following sequences during synthesis to enable cloning:

5'-GAAGACTTAGCA-SILK-GGTACGTCTTC-3' (SEQ ID NOS 2825 and 2826) where "SILK" is a polynucleotide sequence selected according to the teachings of Example 2.

Resulting DNA was digested with BbsI and ligated into either Expression Vector RM618 (SEQ ID NO:1399) or Expression Vector RM652 (SEQ ID NO:1400) which had been digested with BtgZI and treated with Calf Intestinal Alkaline Phosphatase. Ligated material was transformed into *E. coli* for clonal isolation and DNA amplification using standard methods. *Pichia* (*Komagataella*) *pastoris*

Expression vectors containing an R, N, or C sequence were transformed into *Pichia* (*Komagataella*) *pastoris* (strain RMs71, which is strain GS115 (NRRL Y15851) with the mutation in the HIS4 gene restored to wild-type via transformation with a fragment of the wild-type genome (NRRLY 11430) and selection on defined medium agar plates lacking histidine) using the PEG method (Cregg, J. M., DNA-mediated transformation, *Methods Mol. Biol.*, 389, pg. 27-42 (2007).). The expression vector consisted of a targeting region (HIS4), a dominant resistance marker (nat-conferring resistance to nourseothricin), a promoter (pGAP), a secretion signal (alpha mating factor leader and pro sequence), and a terminator (pAOX1 pA signal).

Transformants were plated on YPD agar plates containing 25 µg/ml nourseothricin and incubated for 48 hours at 30° C. Two clones from each transformation were inoculated into 400 µl of YPD in a 96-well square-well block, and incubated for 48 hours at 30° C. with agitation at 1000 rpm. Cells were pelleted via centrifugation, and the supernatant was recovered for analysis of silk polypeptide content via western blot. The resulting data demonstrates a variety of expression and secretion phenotypes, ranging from undetectable polypeptide levels in the supernatant to strong signal on the western blot indicative of relatively high titre.

Figure 4:
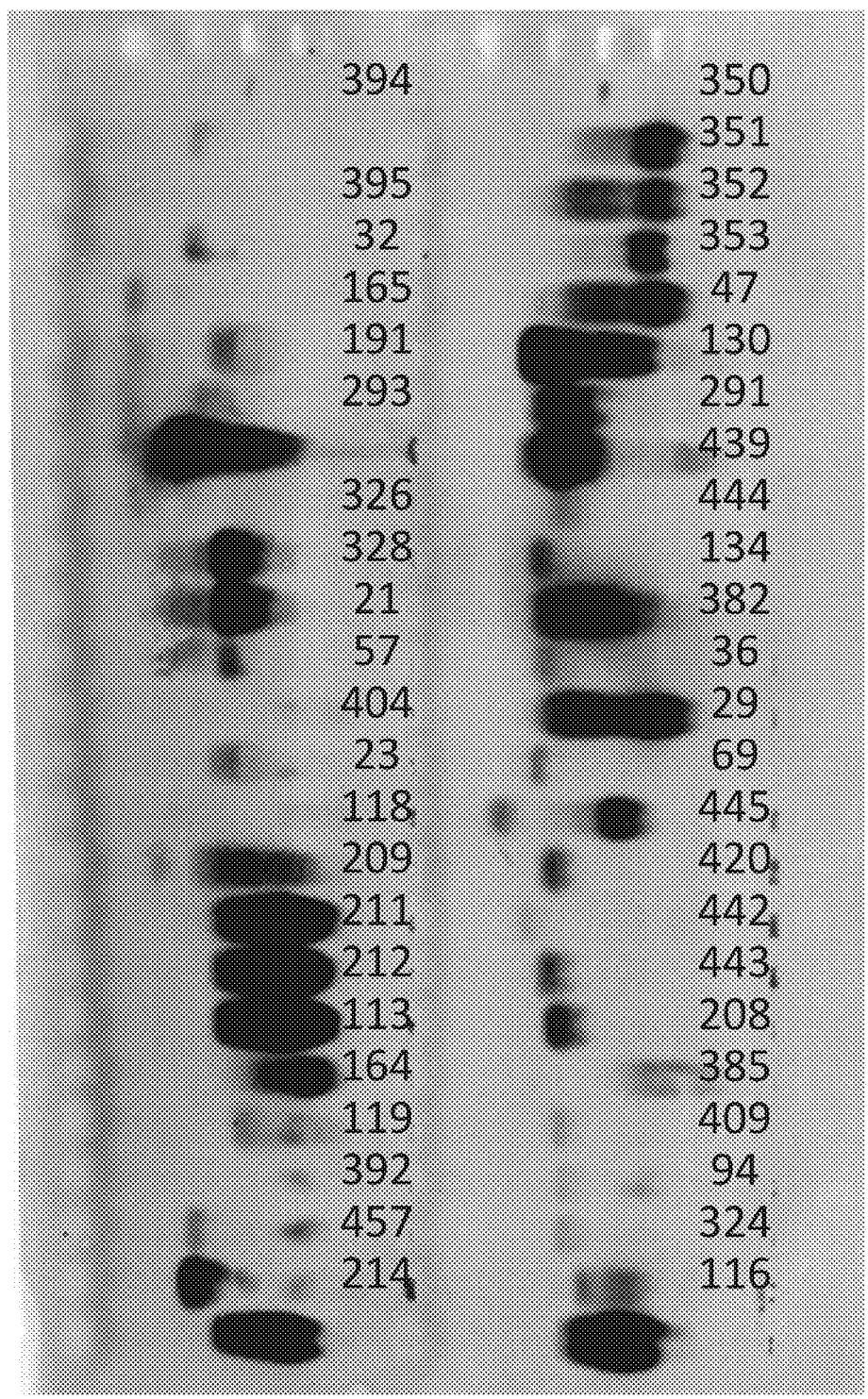
FIG. 4 shows a representative western blot of expressed silk repeat sequences and terminal domain sequences.
Figure 5:
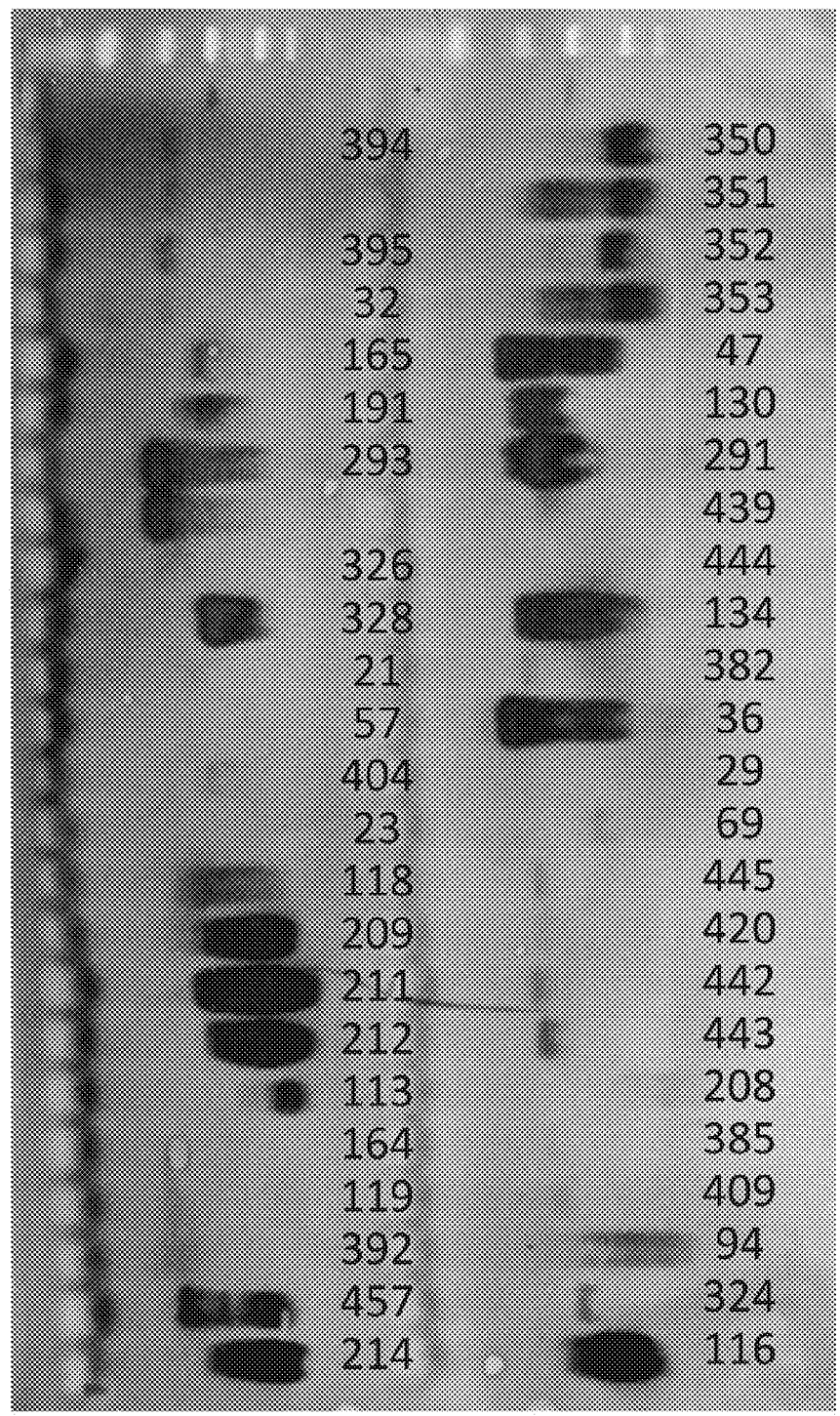
FIG. 5 shows a representative western blot of expressed silk repeat sequences and terminal domain sequences.

Successful polypeptide expression and secretion was judged by western blot. Each western lane was scored as 1: No band 2: Moderate band or 3: Intense band. The higher of the two scores for each clone was recorded. Representative western blots with construct numbers labeled are shown in FIG. 4 and FIG. 5, with additional western blots with representative clones shown in FIG. 14. A complete listing of all R, N, and C sequences tested along with western blot results is shown in Table 2. Silk polypeptides from numerous species expressed successfully, encompassing every category of gland and all domain types.

TABLE 2

Silk polypeptide sequences

| Construct # | Species | N/C/R sequence | Nucleotide SEQ ID NO | Nucleotide with flanking sequences SEQ ID NO: | Amino acid SEQ ID NO: | Western Results (1 = no band 2 = weak band 3 = strong band) |
| --- | --- | --- | --- | --- | --- | --- |
| 1 | *Aliatypus gulosus* | C | 1 | 468 | 932 | no data |
| 2 | *Aptostichus* sp. AS217 | C | 2 | 469 | 933 | 3 |
| 3 | *Aptostichus* sp. AS220 | C | 3 | 470 | 934 | 3 |
| 4 | *Araneus diadematus* | C | 4 | 471 | 935 | 3 |
| 5 | *Araneus diadematus* | C | 5 | 472 | 936 | no data |
| 6 | *Araneus diadematus* | C | 6 | 473 | 937 | no data |
| 7 | *Araneus diadematus* | C | 7 | 474 | 938 | 3 |
| 8 | *Atypoides riversi* | C | 8 | 475 | 939 | 2 |

TABLE 2-continued

Silk polypeptide sequences

| Construct # | Species | N/C/R sequence | Nucleotide SEQ ID NO | Nucleotide with flanking sequences SEQ ID NO: | Amino acid SEQ ID NO: | Western Results (1 = no band 2 = weak band 3 = strong band) |
|---|---|---|---|---|---|---|
| 9 | Bothriocyrtum californicum | C | 9 | 476 | 940 | 2 |
| 10 | Bothriocyrtum californicum | C | 10 | 477 | 941 | 3 |
| 11 | Bothriocyrtum californicum | C | 11 | 478 | 942 | 2 |
| 12 | Deinopis Spinosa | C | 12 | 479 | 943 | 3 |
| 13 | Deinopis Spinosa | C | 13 | 480 | 944 | 3 |
| 14 | Deinopis Spinosa | C | 14 | 481 | 945 | 2 |
| 15 | Dolomedes tenebrosus | C | 15 | 482 | 946 | 2 |
| 16 | Euagrus chisoseus | C | 16 | 483 | 947 | 3 |
| 17 | Plectreurys tristis | C | 17 | 484 | 948 | 3 |
| 18 | Plectreurys tristis | C | 18 | 485 | 949 | 2 |
| 19 | Plectreurys tristis | C | 19 | 486 | 950 | 1 |
| 20 | Plectreurys tristis | C | 20 | 487 | 951 | 3 |
| 21 | Agelenopsis aperta | C | 21 | 488 | 952 | 2 |
| 22 | Araneus gemmoides | C | 22 | 489 | 953 | 3 |
| 23 | Argiope argentata | C | 23 | 490 | 954 | 1 |
| 24 | Argiope aurantia | C | 24 | 491 | 955 | no data |
| 25 | Argiope bruennichi | C | 25 | 492 | 956 | no data |
| 26 | Argiope bruennichi | C | 26 | 493 | 957 | 1 |
| 27 | Atypoides riversi | C | 27 | 494 | 958 | 1 |
| 28 | Avicularia juruensis | C | 28 | 495 | 959 | 1 |
| 29 | Deinopis Spinosa | C | 29 | 496 | 960 | 2 |
| 30 | Latrodectus hesperus | C | 30 | 497 | 961 | 2 |
| 31 | Nephila antipodiana | C | 31 | 498 | 962 | 2 |
| 32 | Nephila clavata | C | 32 | 499 | 963 | 2 |
| 33 | Nephila clavipes | C | 33 | 500 | 964 | 1 |
| 34 | Nephilengys cruentata | C | 34 | 501 | 965 | 3 |
| 35 | Uloborus diversus | C | 35 | 502 | 966 | no data |
| 36 | Araneus ventricosus | C | 36 | 503 | 967 | 3 |
| 37 | Argiope argentata | C | 37 | 504 | 968 | 3 |
| 38 | Deinopis spinosa | C | 38 | 505 | 969 | 2 |
| 39 | Latrodectus hesperus | C | 39 | 506 | 970 | 3 |
| 40 | Metepeira grandiosa | C | 40 | 507 | 971 | 3 |
| 41 | Nephila antipodiana | C | 41 | 508 | 972 | 3 |
| 42 | Nephila clavipes | C | 42 | 509 | 973 | 3 |
| 43 | Nephilengys cruentata | C | 43 | 510 | 974 | 1 |
| 44 | Parawixia bistriata | C | 44 | 511 | 975 | 3 |
| 45 | Uloborus diversus | C | 45 | 512 | 976 | 2 |
| 46 | Araneus ventricosus | C | 46 | 513 | 977 | no data |
| 47 | Argiope trifasciata | C | 47 | 514 | 978 | 3 |
| 48 | Nephila clavipes | C | 48 | 515 | 979 | 3 |
| 49 | Nephilengys cruentata | C | 49 | 516 | 980 | 3 |
| 50 | Nephila madagascariensis | C | 50 | 517 | 981 | 3 |
| 51 | Latrodectus hesperus | C | 51 | 518 | 982 | 2 |
| 52 | Araneus ventricosus | C | 52 | 519 | 983 | 2 |
| 53 | Argiope trifasciata | C | 53 | 520 | 984 | 2 |
| 54 | Parawixia bistriata | C | 54 | 521 | 985 | 3 |
| 55 | Uloborus diversus | C | 55 | 522 | 986 | 1 |
| 56 | Agelenopsis aperta | C | 56 | 523 | 987 | 3 |
| 57 | Aphonopelma seemanni | C | 57 | 524 | 988 | 1 |
| 58 | Araneus bicentenarius | C | 58 | 525 | 989 | 3 |
| 59 | Araneus ventricosus | C | 59 | 526 | 990 | 2 |
| 60 | Argiope amoena | C | 60 | 527 | 991 | 3 |
| 61 | Argiope amoena | C | 61 | 528 | 992 | no data |
| 62 | Argiope amoena | C | 62 | 529 | 993 | 3 |
| 63 | Argiope amoena | C | 63 | 530 | 994 | 2 |
| 64 | Argiope aurantia | C | 64 | 531 | 995 | 2 |
| 65 | Argiope bruennichi | C | 65 | 532 | 996 | 2 |
| 66 | Argiope bruennichi | C | 66 | 533 | 997 | 3 |
| 67 | Argiope trifasciata | C | 67 | 534 | 998 | 3 |
| 68 | Argiope trifasciata | C | 68 | 535 | 999 | 2 |
| 69 | Avicularia juruensis | C | 69 | 536 | 1000 | 2 |
| 70 | Avicularia juruensis | C | 70 | 537 | 1001 | 3 |
| 71 | Avicularia juruensis | C | 71 | 538 | 1002 | 3 |
| 72 | Deinopis spinosa | C | 72 | 539 | 1003 | 1 |
| 73 | Deinopis spinosa | C | 73 | 540 | 1004 | 2 |
| 74 | Deinopis spinosa | C | 74 | 541 | 1005 | no data |
| 75 | Diguetia canities | C | 75 | 542 | 1006 | 2 |
| 76 | Diguetia canities | C | 76 | 543 | 1007 | 3 |
| 77 | Dolomedes tenebrosus | C | 77 | 544 | 1008 | 3 |
| 78 | Euprosthenops australis | C | 78 | 545 | 1009 | 3 |
| 79 | Euprosthenops australis | C | 79 | 546 | 1010 | 2 |
| 80 | Euprosthenops australis | C | 80 | 547 | 1011 | 2 |
| 81 | Gasteracantha mammosa | C | 81 | 548 | 1012 | 3 |

TABLE 2-continued

Silk polypeptide sequences

| Construct # | Species | N/C/R sequence | Nucleotide SEQ ID NO | Nucleotide with flanking sequences SEQ ID NO: | Amino acid SEQ ID NO: | Western Results (1 = no band 2 = weak band 3 = strong band) |
|---|---|---|---|---|---|---|
| 82 | Hypochilus thorelli | C | 82 | 549 | 1013 | 2 |
| 83 | Megahexura fulva | C | 83 | 550 | 1014 | 2 |
| 84 | Nephila antipodiana | C | 84 | 551 | 1015 | 3 |
| 85 | Nephila clavipes | C | 85 | 552 | 1016 | 3 |
| 86 | Nephila clavipes | C | 86 | 553 | 1017 | no data |
| 87 | Nephila madagascariensis | C | 87 | 554 | 1018 | 3 |
| 88 | Nephila madagascariensis | C | 88 | 555 | 1019 | 3 |
| 89 | Nephila pilipes | C | 89 | 556 | 1020 | 3 |
| 90 | Nephila senegalensis | C | 90 | 557 | 1021 | 3 |
| 91 | Nephilengys cruentata | C | 91 | 558 | 1022 | 2 |
| 92 | Parawixia bistriata | C | 92 | 559 | 1023 | 3 |
| 93 | Parawixia bistriata | C | 93 | 560 | 1024 | 2 |
| 94 | Peucetia viridans | C | 94 | 561 | 1025 | 2 |
| 95 | Poecilotheria regalis | C | 95 | 562 | 1026 | 1 |
| 96 | Tetragnatha kauaiensis | C | 96 | 563 | 1027 | 1 |
| 97 | Tetragnatha versicolor | C | 97 | 564 | 1028 | 2 |
| 98 | Uloborus diversus | C | 98 | 565 | 1029 | 3 |
| 99 | Araneus diadematus | C | 99 | 566 | 1030 | 1 |
| 100 | Araneus diadematus | C | 100 | 567 | 1031 | 3 |
| 101 | Araneus diadematus | C | 101 | 568 | 1032 | 2 |
| 102 | Araneus diadematus | C | 102 | 569 | 1033 | 3 |
| 103 | Araneus diadematus | C | 103 | 570 | 1034 | 3 |
| 104 | Araneus diadematus | C | 104 | 571 | 1035 | 3 |
| 105 | Araneus diadematus | C | 105 | 572 | 1036 | 2 |
| 106 | Araneus diadematus | C | 106 | 573 | 1037 | 3 |
| 107 | Araneus diadematus | C | 107 | 574 | 1038 | 3 |
| 108 | Agelenopsis aperta | N | 108 | 575 | 1039 | 3 |
| 109 | Argiope argentata | N | 109 | 576 | 1040 | 3 |
| 110 | Argiope bruennichi | N | 110 | 577 | 1041 | 1 |
| 111 | Argiope bruennichi | N | 111 | 578 | 1042 | 2 |
| 112 | Latrodectus hesperus | N | 112 | 579 | 1043 | 1 |
| 113 | Nephila clavata | N | 113 | 580 | 1044 | 3 |
| 114 | Araneus ventricosus | N | 114 | 581 | 1045 | 3 |
| 115 | Metepeira grandiosa | N | 115 | 582 | 1046 | 3 |
| 116 | Uloborus diversus | N | 116 | 583 | 1047 | 3 |
| 117 | Nephila clavipes | N | 117 | 584 | 1048 | 3 |
| 118 | Nephila madagascariensis | N | 118 | 585 | 1049 | 3 |
| 119 | Latrodectus hesperus | N | 119 | 586 | 1050 | 2 |
| 120 | Latrodectus hesperus | N | 120 | 587 | 1051 | 2 |
| 121 | Agelenopsis aperta | N | 121 | 588 | 1052 | 1 |
| 122 | Argiope bruennichi | N | 122 | 589 | 1053 | 3 |
| 123 | Argiope trifasciata | N | 123 | 590 | 1054 | 3 |
| 124 | Bothriocyrtum californicum | N | 124 | 591 | 1055 | 2 |
| 125 | Deinopis spinosa | N | 125 | 592 | 1056 | 3 |
| 126 | Diguetia canities | N | 126 | 593 | 1057 | 3 |
| 127 | Diguetia canities | N | 127 | 594 | 1058 | 3 |
| 128 | Euprosthenops australis | N | 128 | 595 | 1059 | 3 |
| 129 | Kukulcania hibernalis | N | 129 | 596 | 1060 | 1 |
| 130 | Kukulcania hibernalis | N | 130 | 597 | 1061 | 3 |
| 131 | Nephila clavipes | N | 131 | 598 | 1062 | 3 |
| 132 | Nephila clavipes | N | 132 | 599 | 1063 | 3 |
| 133 | Nephila clavipes | N | 133 | 600 | 1064 | 3 |
| 134 | Nephila madagascariensis | N | 134 | 601 | 1065 | 3 |
| 135 | Araneus diadematus | N | 135 | 602 | 1066 | 3 |
| 136 | Araneus diadematus | N | 136 | 603 | 1067 | 2 |
| 137 | Araneus diadematus | N | 137 | 604 | 1068 | 3 |
| 138 | Araneus diadematus | N | 138 | 605 | 1069 | 2 |
| 139 | Araneus diadematus | N | 139 | 606 | 1070 | 2 |
| 140 | Araneus diadematus | N | 140 | 607 | 1071 | 3 |
| 141 | Araneus diadematus | N | 141 | 608 | 1072 | 1 |
| 142 | Araneus diadematus | N | 142 | 609 | 1073 | 3 |
| 143 | Araneus diadematus | N | 143 | 610 | 1074 | 2 |
| 144 | Araneus diadematus | N | 144 | 611 | 1075 | 2 |
| 145 | Araneus diadematus | N | 145 | 612 | 1076 | 3 |
| 146 | Aliatypus gulosus | R | 146 | 613 | 1077 | 3 |
| 147 | Aliatypus gulosus | R | 147 | 614 | 1078 | 3 |
| 148 | Aliatypus gulosus | R | 148 | 615 | 1079 | 3 |
| 149 | Aliatypus gulosus | R | 149 | 616 | 1080 | 3 |
| 150 | Aliatypus gulosus | R | 150 | 617 | 1081 | 3 |
| 151 | Aliatypus gulosus | R | 151 | 618 | 1082 | 3 |
| 152 | Aliatypus gulosus | R | 152 | 619 | 1083 | 3 |
| 153 | Aptostichus sp. AS217 | R | 153 | 620 | 1084 | 3 |
| 154 | Aptostichus sp. AS217 | R | 154 | 621 | 1085 | 3 |

TABLE 2-continued

Silk polypeptide sequences

| Construct # | Species | N/C/R sequence | Nucleotide SEQ ID NO | Nucleotide with flanking sequences SEQ ID NO: | Amino acid SEQ ID NO: | Western Results (1 = no band 2 = weak band 3 = strong band) |
|---|---|---|---|---|---|---|
| 155 | Aptostichus sp. AS217 | R | 155 | 622 | 1086 | 3 |
| 156 | Aptostichus sp. AS217 | R | 156 | 623 | 1087 | 3 |
| 157 | Aptostichus sp. AS217 | R | 157 | 624 | 1088 | 3 |
| 158 | Aptostichus sp. AS220 | R | 158 | 625 | 1089 | 2 |
| 159 | Aptostichus sp. AS220 | R | 159 | 626 | 1090 | 3 |
| 160 | Aptostichus sp. AS220 | R | 160 | 627 | 1091 | 3 |
| 161 | Araneus diadematus | R | 161 | 628 | 1092 | 3 |
| 162 | Araneus diadematus | R | 162 | 629 | 1093 | 2 |
| 163 | Araneus diadematus | R | 163 | 630 | 1094 | 2 |
| 164 | Araneus diadematus | R | 164 | 631 | 1095 | 2 |
| 165 | Araneus diadematus | R | 165 | 632 | 1096 | 2 |
| 166 | Atypoides riversi | R | 166 | 633 | 1097 | 3 |
| 167 | Atypoides riversi | R | 167 | 634 | 1098 | 3 |
| 168 | Atypoides riversi | R | 168 | 635 | 1099 | 2 |
| 169 | Atypoides riversi | R | 169 | 636 | 1100 | 3 |
| 170 | Atypoides riversi | R | 170 | 637 | 1101 | no data |
| 171 | Atypoides riversi | R | 171 | 638 | 1102 | 1 |
| 172 | Atypoides riversi | R | 172 | 639 | 1103 | 3 |
| 173 | Bothriocyrtum californicum | R | 173 | 640 | 1104 | 3 |
| 174 | Bothriocyrtum californicum | R | 174 | 641 | 1105 | 3 |
| 175 | Bothriocyrtum californicum | R | 175 | 642 | 1106 | 3 |
| 176 | Bothriocyrtum californicum | R | 176 | 643 | 1107 | 3 |
| 177 | Bothriocyrtum californicum | R | 177 | 644 | 1108 | 3 |
| 178 | Bothriocyrtum californicum | R | 178 | 645 | 1109 | 3 |
| 179 | Bothriocyrtum californicum | R | 179 | 646 | 1110 | 3 |
| 180 | Bothriocyrtum californicum | R | 180 | 647 | 1111 | 3 |
| 181 | Bothriocyrtum californicum | R | 181 | 648 | 1112 | 3 |
| 182 | Bothriocyrtum californicum | R | 182 | 649 | 1113 | 3 |
| 183 | Deinopis Spinosa | R | 183 | 650 | 1114 | 3 |
| 184 | Deinopis Spinosa | R | 184 | 651 | 1115 | 2 |
| 185 | Deinopis Spinosa | R | 185 | 652 | 1116 | 3 |
| 186 | Deinopis Spinosa | R | 186 | 653 | 1117 | 3 |
| 187 | Deinopis Spinosa | R | 187 | 654 | 1118 | 3 |
| 188 | Deinopis Spinosa | R | 188 | 655 | 1119 | no data |
| 189 | Deinopis Spinosa | R | 189 | 656 | 1120 | 2 |
| 190 | Deinopis Spinosa | R | 190 | 657 | 1121 | 3 |
| 191 | Dolomedes tenebrosus | R | 191 | 658 | 1122 | 2 |
| 192 | Dolomedes tenebrosus | R | 192 | 659 | 1123 | no data |
| 193 | Dolomedes tenebrosus | R | 193 | 660 | 1124 | 3 |
| 194 | Euagrus chisoseus | R | 194 | 661 | 1125 | 2 |
| 195 | Euagrus chisoseus | R | 195 | 662 | 1126 | 2 |
| 196 | Euagrus chisoseus | R | 196 | 663 | 1127 | 2 |
| 197 | Plectreurys tristis | R | 197 | 664 | 1128 | 3 |
| 198 | Plectreurys tristis | R | 198 | 665 | 1129 | 3 |
| 199 | Plectreurys tristis | R | 199 | 666 | 1130 | 3 |
| 200 | Plectreurys tristis | R | 200 | 667 | 1131 | 2 |
| 201 | Plectreurys tristis | R | 201 | 668 | 1132 | 3 |
| 202 | Plectreurys tristis | R | 202 | 669 | 1133 | 3 |
| 203 | Plectreurys tristis | R | 203 | 670 | 1134 | 2 |
| 204 | Plectreurys tristis | R | 204 | 671 | 1135 | 3 |
| 205 | Plectreurys tristis | R | 205 | 672 | 1136 | 3 |
| 206 | Plectreurys tristis | R | 206 | 673 | 1137 | 3 |
| 207 | Plectreurys tristis | R | 207 | 674 | 1138 | 3 |
| 208 | Plectreurys tristis | R | 208 | 675 | 1139 | 2 |
| 209 | Plectreurys tristis | R | 209 | 676 | 1140 | 3 |
| 210 | Plectreurys tristis | R | 210 | 677 | 1141 | 3 |
| 211 | Plectreurys tristis | R | 211 | 678 | 1142 | 3 |
| 212 | Plectreurys tristis | R | 212 | 679 | 1143 | 3 |
| 213 | Plectreurys tristis | R | 213 | 680 | 1144 | 3 |
| 214 | Plectreurys tristis | R | 214 | 681 | 1145 | 3 |
| 215 | Plectreurys tristis | R | 215 | 682 | 1146 | 3 |
| 216 | Agelenopsis aperta | R | 216 | 683 | 1147 | 3 |
| 217 | Agelenopsis aperta | R | 217 | 684 | 1148 | 3 |
| 218 | Araneus gemmoides | R | 218 | 685 | 1149 | 2 |
| 219 | Araneus gemmoides | R | 219 | 686 | 1150 | 3 |
| 220 | Araneus gemmoides | R | 220 | 687 | 1151 | 2 |
| 221 | Argiope amoena | R | 221 | 688 | 1152 | no data |
| 222 | Argiope amoena | R | 222 | 689 | 1153 | 3 |
| 223 | Argiope argentata | R | 223 | 690 | 1154 | 2 |
| 224 | Argiope argentata | R | 224 | 691 | 1155 | 2 |
| 225 | Argiope argentata | R | 225 | 692 | 1156 | 2 |
| 226 | Argiope aurantia | R | 226 | 693 | 1157 | 2 |
| 227 | Argiope aurantia | R | 227 | 694 | 1158 | 2 |

TABLE 2-continued

Silk polypeptide sequences

| Construct # | Species | N/C/R sequence | Nucleotide SEQ ID NO | Nucleotide with flanking sequences SEQ ID NO: | Amino acid SEQ ID NO: | Western Results (1 = no band 2 = weak band 3 = strong band) |
|---|---|---|---|---|---|---|
| 228 | Argiope aurantia | R | 228 | 695 | 1159 | 2 |
| 229 | Argiope aurantia | R | 229 | 696 | 1160 | 2 |
| 230 | Argiope bruennichi | R | 230 | 697 | 1161 | 2 |
| 231 | Argiope bruennichi | R | 231 | 698 | 1162 | 2 |
| 232 | Argiope bruennichi | R | 232 | 699 | 1163 | 2 |
| 233 | Argiope bruennichi | R | 233 | 700 | 1164 | 2 |
| 234 | Argiope bruennichi | R | 234 | 701 | 1165 | 3 |
| 235 | Argiope bruennichi | R | 235 | 702 | 1166 | 2 |
| 236 | Argiope bruennichi | R | 236 | 703 | 1167 | 2 |
| 237 | Argiope bruennichi | R | 237 | 704 | 1168 | 2 |
| 238 | Argiope bruennichi | R | 238 | 705 | 1169 | 2 |
| 239 | Argiope bruennichi | R | 239 | 706 | 1170 | 3 |
| 240 | Argiope bruennichi | R | 240 | 707 | 1171 | 2 |
| 241 | Argiope bruennichi | R | 241 | 708 | 1172 | 2 |
| 242 | Argiope bruennichi | R | 242 | 709 | 1173 | 3 |
| 243 | Argiope bruennichi | R | 243 | 710 | 1174 | 2 |
| 244 | Argiope bruennichi | R | 244 | 711 | 1175 | 3 |
| 245 | Argiope bruennichi | R | 245 | 712 | 1176 | 2 |
| 246 | Argiope bruennichi | R | 246 | 713 | 1177 | 2 |
| 247 | Argiope bruennichi | R | 247 | 714 | 1178 | 3 |
| 248 | Argiope bruennichi | R | 248 | 715 | 1179 | 2 |
| 249 | Argiope bruennichi | R | 249 | 716 | 1180 | 2 |
| 250 | Atypoides riversi | R | 250 | 717 | 1181 | 2 |
| 251 | Atypoides riversi | R | 251 | 718 | 1182 | 2 |
| 252 | Atypoides riversi | R | 252 | 719 | 1183 | 3 |
| 253 | Atypoides riversi | R | 253 | 720 | 1184 | 1 |
| 254 | Atypoides riversi | R | 254 | 721 | 1185 | 2 |
| 255 | Atypoides riversi | R | 255 | 722 | 1186 | 2 |
| 256 | Atypoides riversi | R | 256 | 723 | 1187 | 2 |
| 257 | Avicularia juruensis | R | 257 | 724 | 1188 | 2 |
| 258 | Avicularia juruensis | R | 258 | 725 | 1189 | 1 |
| 259 | Avicularia juruensis | R | 259 | 726 | 1190 | 1 |
| 260 | Deinopis Spinosa | R | 260 | 727 | 1191 | 3 |
| 261 | Deinopis Spinosa | R | 261 | 728 | 1192 | 3 |
| 262 | Deinopis Spinosa | R | 262 | 729 | 1193 | 2 |
| 263 | Latrodectus hesperus | R | 263 | 730 | 1194 | 3 |
| 264 | Latrodectus hesperus | R | 264 | 731 | 1195 | 3 |
| 265 | Latrodectus hesperus | R | 265 | 732 | 1196 | 2 |
| 266 | Latrodectus hesperus | R | 266 | 733 | 1197 | 1 |
| 267 | Latrodectus hesperus | R | 267 | 734 | 1198 | 1 |
| 268 | Latrodectus hesperus | R | 268 | 735 | 1199 | 2 |
| 269 | Nephila antipodiana | R | 269 | 736 | 1200 | 3 |
| 270 | Nephila clavata | R | 270 | 737 | 1201 | 2 |
| 271 | Nephila clavata | R | 271 | 738 | 1202 | no data |
| 272 | Nephila clavata | R | 272 | 739 | 1203 | 2 |
| 273 | Nephila clavata | R | 273 | 740 | 1204 | 2 |
| 274 | Nephila clavata | R | 274 | 741 | 1205 | 1 |
| 275 | Nephila clavata | R | 275 | 742 | 1206 | 1 |
| 276 | Nephila clavata | R | 276 | 743 | 1207 | 2 |
| 277 | Nephila clavata | R | 277 | 744 | 1208 | 1 |
| 278 | Nephila clavipes | R | 278 | 745 | 1209 | 2 |
| 279 | Nephila clavipes | R | 279 | 746 | 1210 | 2 |
| 280 | Nephilengys cruentata | R | 280 | 747 | 1211 | no data |
| 281 | Uloborus diversus | R | 281 | 748 | 1212 | 3 |
| 282 | Uloborus diversus | R | 282 | 749 | 1213 | 1 |
| 283 | Uloborus diversus | R | 283 | 750 | 1214 | 3 |
| 284 | Uloborus diversus | R | 284 | 751 | 1215 | 1 |
| 285 | Araneus ventricosus | R | 285 | 752 | 1216 | 2 |
| 286 | Araneus ventricosus | R | 286 | 753 | 1217 | 3 |
| 287 | Araneus ventricosus | R | 287 | 754 | 1218 | 2 |
| 288 | Araneus ventricosus | R | 288 | 755 | 1219 | 2 |
| 289 | Araneus ventricosus | R | 289 | 756 | 1220 | 3 |
| 290 | Araneus ventricosus | R | 290 | 757 | 1221 | 2 |
| 291 | Araneus ventricosus | R | 291 | 758 | 1222 | 3 |
| 292 | Araneus ventricosus | R | 292 | 759 | 1223 | 3 |
| 293 | Argiope argentata | R | 293 | 760 | 1224 | 3 |
| 294 | Deinopis spinosa | R | 294 | 761 | 1225 | 2 |
| 295 | Latrodectus hesperus | R | 295 | 762 | 1226 | 3 |
| 296 | Latrodectus hesperus | R | 296 | 763 | 1227 | 3 |
| 297 | Metepeira grandiosa | R | 297 | 764 | 1228 | 2 |
| 298 | Metepeira grandiosa | R | 298 | 765 | 1229 | 3 |
| 299 | Nephila antipodiana | R | 299 | 766 | 1230 | 2 |
| 300 | Nephila clavipes | R | 300 | 767 | 1231 | 3 |

TABLE 2-continued

Silk polypeptide sequences

| Construct # | Species | N/C/R sequence | Nucleotide SEQ ID NO | Nucleotide with flanking sequences SEQ ID NO: | Amino acid SEQ ID NO: | Western Results (1 = no band 2 = weak band 3 = strong band) |
|---|---|---|---|---|---|---|
| 301 | Nephila clavipes | R | 301 | 768 | 1232 | 3 |
| 302 | Nephila clavipes | R | 302 | 769 | 1233 | 2 |
| 303 | Nephila clavipes | R | 303 | 770 | 1234 | 3 |
| 304 | Nephilengys cruentata | R | 304 | 771 | 1235 | 2 |
| 305 | Nephilengys cruentata | R | 305 | 772 | 1236 | 3 |
| 306 | Nephilengys cruentata | R | 306 | 773 | 1237 | 3 |
| 307 | Nephilengys cruentata | R | 307 | 774 | 1238 | no data |
| 308 | Nephilengys cruentata | R | 308 | 775 | 1239 | 3 |
| 309 | Nephilengys cruentata | R | 309 | 776 | 1240 | 2 |
| 310 | Nephilengys cruentata | R | 310 | 777 | 1241 | 3 |
| 311 | Nephilengys cruentata | R | 311 | 778 | 1242 | 3 |
| 312 | Nephilengys cruentata | R | 312 | 779 | 1243 | 2 |
| 313 | Parawixia bistriata | R | 313 | 780 | 1244 | 3 |
| 314 | Parawixia bistriata | R | 314 | 781 | 1245 | 3 |
| 315 | Uloborus diversus | R | 315 | 782 | 1246 | 3 |
| 316 | Uloborus diversus | R | 316 | 783 | 1247 | 3 |
| 317 | Uloborus diversus | R | 317 | 784 | 1248 | 3 |
| 318 | Uloborus diversus | R | 318 | 785 | 1249 | 2 |
| 319 | Araneus ventricosus | R | 319 | 786 | 1250 | 2 |
| 320 | Argiope trifasciata | R | 320 | 787 | 1251 | 3 |
| 321 | Argiope trifasciata | R | 321 | 788 | 1252 | 3 |
| 322 | Argiope trifasciata | R | 322 | 789 | 1253 | 3 |
| 323 | Nephila clavipes | R | 323 | 790 | 1254 | 2 |
| 324 | Nephila clavipes | R | 324 | 791 | 1255 | 3 |
| 325 | Nephila clavipes | R | 325 | 792 | 1256 | 3 |
| 326 | Nephila clavipes | R | 326 | 793 | 1257 | 3 |
| 327 | Nephila clavipes | R | 327 | 794 | 1258 | 3 |
| 328 | Nephila clavipes | R | 328 | 795 | 1259 | 3 |
| 329 | Nephilengys cruentata | R | 329 | 796 | 1260 | 3 |
| 330 | Nephilengys cruentata | R | 330 | 797 | 1261 | 2 |
| 331 | Nephilengys cruentata | R | 331 | 798 | 1262 | 1 |
| 332 | Nephila madagascariensis | R | 332 | 799 | 1263 | 2 |
| 333 | Nephila madagascariensis | R | 333 | 800 | 1264 | 3 |
| 334 | Nephila madagascariensis | R | 334 | 801 | 1265 | 2 |
| 335 | Nephila madagascariensis | R | 335 | 802 | 1266 | 3 |
| 336 | Nephila madagascariensis | R | 336 | 803 | 1267 | 1 |
| 337 | Nephila madagascariensis | R | 337 | 804 | 1268 | no data |
| 338 | Nephila madagascariensis | R | 338 | 805 | 1269 | 2 |
| 339 | Nephila madagascariensis | R | 339 | 806 | 1270 | 2 |
| 340 | Latrodectus hesperus | R | 340 | 807 | 1271 | 3 |
| 341 | Latrodectus hesperus | R | 341 | 808 | 1272 | 2 |
| 342 | Latrodectus hesperus | R | 342 | 809 | 1273 | 3 |
| 343 | Latrodectus hesperus | R | 343 | 810 | 1274 | 2 |
| 344 | Latrodectus hesperus | R | 344 | 811 | 1275 | no data |
| 345 | Latrodectus hesperus | R | 345 | 812 | 1276 | 2 |
| 346 | Latrodectus hesperus | R | 346 | 813 | 1277 | 3 |
| 347 | Latrodectus hesperus | R | 347 | 814 | 1278 | 3 |
| 348 | Latrodectus hesperus | R | 348 | 815 | 1279 | 3 |
| 349 | Latrodectus hesperus | R | 349 | 816 | 1280 | 2 |
| 350 | Argiope amoena | R | 350 | 817 | 1281 | 3 |
| 351 | Argiope amoena | R | 351 | 818 | 1282 | 3 |
| 352 | Argiope amoena | R | 352 | 819 | 1283 | 3 |
| 353 | Argiope amoena | R | 353 | 820 | 1284 | 3 |
| 354 | Araneus ventricosus | R | 354 | 821 | 1285 | 3 |
| 355 | Araneus ventricosus | R | 355 | 822 | 1286 | 3 |
| 356 | Araneus ventricosus | R | 356 | 823 | 1287 | 3 |
| 357 | Araneus ventricosus | R | 357 | 824 | 1288 | 3 |
| 358 | Araneus ventricosus | R | 358 | 825 | 1289 | 3 |
| 359 | Araneus ventricosus | R | 359 | 826 | 1290 | 3 |
| 360 | Araneus ventricosus | R | 360 | 827 | 1291 | 3 |
| 361 | Araneus ventricosus | R | 361 | 828 | 1292 | 3 |
| 362 | Argiope trifasciata | R | 362 | 829 | 1293 | 3 |
| 363 | Argiope trifasciata | R | 363 | 830 | 1294 | 3 |
| 364 | Argiope trifasciata | R | 364 | 831 | 1295 | 3 |
| 365 | Argiope trifasciata | R | 365 | 832 | 1296 | 3 |
| 366 | Argiope trifasciata | R | 366 | 833 | 1297 | 3 |
| 367 | Argiope trifasciata | R | 367 | 834 | 1298 | 3 |
| 368 | Argiope trifasciata | R | 368 | 835 | 1299 | 3 |
| 369 | Argiope trifasciata | R | 369 | 836 | 1300 | 3 |
| 370 | Parawixia bistriata | R | 370 | 837 | 1301 | 3 |
| 371 | Parawixia bistriata | R | 371 | 838 | 1302 | 3 |
| 372 | Uloborus diversus | R | 372 | 839 | 1303 | 3 |
| 373 | Uloborus diversus | R | 373 | 840 | 1304 | 3 |

TABLE 2-continued

Silk polypeptide sequences

| Construct # | Species | N/C/R sequence | Nucleotide SEQ ID NO | Nucleotide with flanking sequences SEQ ID NO: | Amino acid SEQ ID NO: | Western Results (1 = no band 2 = weak band 3 = strong band) |
|---|---|---|---|---|---|---|
| 374 | Uloborus diversus | R | 374 | 841 | 1305 | 3 |
| 375 | Uloborus diversus | R | 375 | 842 | 1306 | 3 |
| 376 | Agelenopsis aperta | R | 376 | 843 | 1307 | 3 |
| 377 | Agelenopsis aperta | R | 377 | 844 | 1308 | 3 |
| 378 | Agelenopsis aperta | R | 378 | 845 | 1309 | 2 |
| 379 | Agelenopsis aperta | R | 379 | 846 | 1310 | 2 |
| 380 | Aphonopelma seemanni | R | 380 | 847 | 1311 | 3 |
| 381 | Araneus ventricosus | R | 381 | 848 | 1312 | 3 |
| 382 | Argiope aurantia | R | 382 | 849 | 1313 | 3 |
| 383 | Argiope bruennichi | R | 383 | 850 | 1314 | 3 |
| 384 | Argiope bruennichi | R | 384 | 851 | 1315 | 3 |
| 385 | Argiope bruennichi | R | 385 | 852 | 1316 | 3 |
| 386 | Argiope bruennichi | R | 386 | 853 | 1317 | 3 |
| 387 | Argiope bruennichi | R | 387 | 854 | 1318 | 3 |
| 388 | Argiope bruennichi | R | 388 | 855 | 1319 | 3 |
| 389 | Argiope bruennichi | R | 389 | 856 | 1320 | 3 |
| 390 | Argiope bruennichi | R | 390 | 857 | 1321 | 3 |
| 391 | Argiope bruennichi | R | 391 | 858 | 1322 | 3 |
| 392 | Argiope bruennichi | R | 392 | 859 | 1323 | 3 |
| 393 | Argiope bruennichi | R | 393 | 860 | 1324 | 3 |
| 394 | Argiope trifasciata | R | 394 | 861 | 1325 | 3 |
| 395 | Argiope trifasciata | R | 395 | 862 | 1326 | 3 |
| 396 | Argiope trifasciata | R | 396 | 863 | 1327 | 1 |
| 397 | Argiope trifasciata | R | 397 | 864 | 1328 | 2 |
| 398 | Argiope trifasciata | R | 398 | 865 | 1329 | 1 |
| 399 | Argiope trifasciata | R | 399 | 866 | 1330 | 3 |
| 400 | Argiope trifasciata | R | 400 | 867 | 1331 | 1 |
| 401 | Avicularia juruensis | R | 401 | 868 | 1332 | 3 |
| 402 | Avicularia juruensis | R | 402 | 869 | 1333 | no data |
| 403 | Avicularia juruensis | R | 403 | 870 | 1334 | 3 |
| 404 | Deinopis spinosa | R | 404 | 871 | 1335 | 3 |
| 405 | Deinopis spinosa | R | 405 | 872 | 1336 | 2 |
| 406 | Deinopis spinosa | R | 406 | 873 | 1337 | 3 |
| 407 | Deinopis spinosa | R | 407 | 874 | 1338 | 2 |
| 408 | Deinopis spinosa | R | 408 | 875 | 1339 | no data |
| 409 | Deinopis spinosa | R | 409 | 876 | 1340 | 3 |
| 410 | Diguetia canities | R | 410 | 877 | 1341 | 3 |
| 411 | Diguetia canities | R | 411 | 878 | 1342 | 3 |
| 412 | Diguetia canities | R | 412 | 879 | 1343 | 3 |
| 413 | Dolomedes tenebrosus | R | 413 | 880 | 1344 | 2 |
| 414 | Dolomedes tenebrosus | R | 414 | 881 | 1345 | 3 |
| 415 | Dolomedes tenebrosus | R | 415 | 882 | 1346 | 3 |
| 416 | Euprosthenops australis | R | 416 | 883 | 1347 | 2 |
| 417 | Euprosthenops australis | R | 417 | 884 | 1348 | 1 |
| 418 | Euprosthenops australis | R | 418 | 885 | 1349 | 3 |
| 419 | Euprosthenops australis | R | 419 | 886 | 1350 | 2 |
| 420 | Euprosthenops australis | R | 420 | 887 | 1351 | 3 |
| 421 | Euprosthenops australis | R | 421 | 888 | 1352 | 3 |
| 422 | Euprosthenops australis | R | 422 | 889 | 1353 | 3 |
| 423 | Euprosthenops australis | R | 423 | 890 | 1354 | 3 |
| 424 | Euprosthenops australis | R | 424 | 891 | 1355 | 3 |
| 425 | Gasteracantha mammosa | R | 425 | 892 | 1356 | 1 |
| 426 | Hypochilus thorelli | R | 426 | 893 | 1357 | 3 |
| 427 | Hypochilus thorelli | R | 427 | 894 | 1358 | 3 |
| 428 | Kukulcania hibernalis | R | 428 | 895 | 1359 | 3 |
| 429 | Kukulcania hibernalis | R | 429 | 896 | 1360 | 3 |
| 430 | Megahexura fulva | R | 430 | 897 | 1361 | no data |
| 431 | Megahexura fulva | R | 431 | 898 | 1362 | 3 |
| 432 | Megahexura fulva | R | 432 | 899 | 1363 | no data |
| 433 | Megahexura fulva | R | 433 | 900 | 1364 | 3 |
| 434 | Megahexura fulva | R | 434 | 901 | 1365 | 3 |
| 435 | Megahexura fulva | R | 435 | 902 | 1366 | 3 |
| 436 | Nephila clavipes | R | 436 | 903 | 1367 | 1 |
| 437 | Nephila clavipes | R | 437 | 904 | 1368 | 3 |
| 438 | Nephila clavipes | R | 438 | 905 | 1369 | 3 |
| 439 | Nephila clavipes | R | 439 | 906 | 1370 | 3 |
| 440 | Nephila clavipes | R | 440 | 907 | 1371 | 1 |
| 441 | Nephila madagascariensis | R | 441 | 908 | 1372 | 3 |
| 442 | Nephila madagascariensis | R | 442 | 909 | 1373 | 3 |
| 443 | Nephila madagascariensis | R | 443 | 910 | 1374 | 3 |
| 444 | Nephila madagascariensis | R | 444 | 911 | 1375 | 3 |
| 445 | Nephila madagascariensis | R | 445 | 912 | 1376 | 2 |
| 446 | Nephila madagascariensis | R | 446 | 913 | 1377 | 2 |

TABLE 2-continued

Silk polypeptide sequences

| Construct # | Species | N/C/R sequence | Nucleotide SEQ ID NO | Nucleotide with flanking sequences SEQ ID NO: | Amino acid SEQ ID NO: | Western Results (1 = no band 2 = weak band 3 = strong band) |
|---|---|---|---|---|---|---|
| 447 | Nephila madagascariensis | R | 447 | 914 | 1378 | 2 |
| 448 | Nephila madagascariensis | R | 448 | 915 | 1379 | 2 |
| 449 | Nephila madagascariensis | R | 449 | 916 | 1380 | 2 |
| 450 | Nephila pilipes | R | 450 | 917 | 1381 | no data |
| 451 | Nephilengys cruentata | R | 451 | 918 | 1382 | 3 |
| 452 | Nephilengys cruentata | R | 452 | 919 | 1383 | 2 |
| 453 | Parawixia bistriata | R | 453 | 920 | 1384 | 2 |
| 454 | Parawixia bistriata | R | 454 | 921 | 1385 | 2 |
| 455 | Parawixia bistriata | R | 455 | 922 | 1386 | 3 |
| 456 | Parawixia bistriata | R | 456 | 923 | 1387 | 2 |
| 457 | Peucetia viridans | R | 457 | 924 | 1388 | 3 |
| 458 | Poecilotheria regalis | R | 458 | 925 | 1389 | 2 |
| 459 | Poecilotheria regalis | R | 459 | 926 | 1390 | 2 |
| 460 | Poecilotheria regalis | R | 460 | 927 | 1391 | no data |
| 461 | Tetragnatha kauaiensis | R | 461 | 928 | 1392 | 2 |
| 462 | Uloborus diversus | R | 462 | 929 | 1393 | 1 |
| RM409 | Argiope bruennichi | R | 463 | 930 | 1394 | no data |
| RM410 | Argiope bruennichi | R | 464 | 931 | 1395 | no data |
| RM411 | Argiope bruennichi | R | 465 | N/A | 1396 | no data |
| RM434 | Argiope bruennichi | R | 466 | N/A | 1397 | no data |
| RM439 | Argiope bruennichi | R | 467 | N/A | 1398 | 3 |

Example 4

Amplification of N, R, and C Sequences for Insertion into an Assembly Vector

The DNA for N, R, and C sequences were PCR amplified from the expression vector and ligated into assembly vectors using AscI/SbfI restriction sites.

The forward primer consisted of the sequence: 5'-CTAAGAGGCGCGCCTAAGCGATGGTCTCAA-3' (SEQ ID NO: 2827)+the first 19 bp of the N, R, or C sequence.

The reverse primer consisted of the last 17 bp of the N, R, or C sequence+3'-GGTACGTCTTCATCGCTATCCTGCAGGCTACGT-5' (SEQ ID NO: 2828).

For example, for sequence:

(SEQ ID NO: 4)
GGTGCAGGTGCAAGGGCTGCTGGAGGCTACGGTGGAGGATACGGTGCCGG

TGCGGGTGCAGGAGCCGGCGCCGCAGCTTCCGCCGGAGCCTCCGGTGGAT

ACGGAGGTGGATATGGTGGCGGAGCTGGTGCTGGTGCCGTAGCAGGTGCC

TCAGCTGGAAGCTACGGAGGTGCTGTTAATAGACTGAGTTCCGCAGGTGC

AGCCTCTAGAGTGTCGTCCAACGTCGCAGCCATTGCATCTGCTGGTGCTG

CCGCTTTGCCCAACGTTATTTCCAACATCTATAGTGGTGTTCTTTCATCT

GGCGTGTCATCCTCCGAAGCACTTATTCAGGCTTTGTTAGAAGTAATCAG

TGCTTTAATTCATGTCTTAGGATCAGCTTCTATCGGCAACGTTTCATCTG

TTGGTGTTAATTCCGCACTTAATGCTGTGCAAAACGCCGTAGGCGCCTAT

GCCGGA the primers used were:

Fwd:
(SEQ ID NO: 2829)
5'-CTAAGAGGCGCGCCTAAGCGATGGTCTCAAGGTGCAGGTGCAAGGG
CTG-3'

Rev:
(SEQ ID NO: 2830)
3'-TAGGCGCCTATGCCGGAGGTACGTCTTCATCGCTATCCTGCAGGCTA
CGT-5'

The PCR reaction solution consisted of 12.5 μL 2×KOD Extreme Buffer, 0.25 μl KOD Extreme Hot Start Polymerase, 0.5 μl 10 μM Fwd oligo, 0.5 μl 10 μM Rev oligo, 5 ng template DNA (expression vector), 0.5 μl of 10 mM dNTPs, and ddH2O added to final volume of 25 μl. The reaction was then thermocycled according to the program:

1. Denature at 94° C. for 5 minutes
2. Denature at 94° C. for 30 seconds
3. Anneal at 55° C. for 30 seconds
4. Extend at 72° C. for 30 seconds
5. Repeat steps 2-4 for 29 additional cycles
6. Final extension at 72° C. for 5 minutes Resulting PCR products were digested with restriction enzymes AscI and SbfI, and ligated into an assembly vector (see description in Example 5), one of KC (RM396, SEQ ID NO:1402), KA (RM397, SEQ ID NO:1403), AC (RM398, SEQ ID NO:1404), AK (RM399, SEQ ID NO:1405), CA (RM400, SEQ ID NO:1406), or CK (RM401, SEQ ID NO:1407) that had been digested with the same enzymes to release an unwanted insert using routine methods.

Example 5

Synthesis of Silk from Argiope bruennichi MaSp2 Blocks (RM439, "18B")

Using the algorithm described in Example 2, a set of 6 repeat blocks (or block co-polymer) from Argiope bruennichi MaSp2 were selected and divided into 2 R sequences consisting of 3 blocks each. The two 3-block R sequences were then synthesized from short oligonucleotides as follows:

Synthesis of RM409 Sequence:

The Argiope bruennichi MaSp2 block sequences were generated using methodology distinct from that employed in Example 3. Oligos RM2919-RM2942 (SEQ ID NOs: 1468-1491) in Table 3 were combined into a single mixture with equal amounts of each oligo, 100 µM in total. The oligos were phosphorylated in a phosphorylation reaction prepared plasmid isolation, and sequence verification according to known techniques.

The resulting oligonucleotide has a 5' to 3' nucleotide sequence of SEQ ID NO: 930 and is identified as RM409.

TABLE 3

Oligo sequences for generating RM409 silk repeat domain (with flanking sequences for cloning) (SEQ ID NO: 930)

| SEQ ID NO: | ID | 5' to 3' Nucleotide Sequence |
|---|---|---|
| 1469 | RM2919 | CGCGCCTTAGCGATGGTCTCAAGGTGGTTACGGTCCAGGCGCTGGTCAACAAGGTCCA |
| 1470 | RM2920 | GGAAGTGGTGGTCAACAAGGACCTGGCGGTCAAGGACCCTACGGTAGTGG |
| 1471 | RM2921 | CCAACAAGGTCCAGGTGGAGCAGGACAGCAGGGTCCGGGAGGCCAAGGAC |
| 1472 | RM2922 | CTTACGGACCAGGTGCTGCTGCTGCCGCCGCTGCCGCTGCCGGAGGTTACGGT |
| 1473 | RM2923 | CCAGGAGCCGGACAACAGGGTCCAGGTGGAGCTGGACAACAAGGTCC |
| 1474 | RM2924 | AGGATCACAAGGTCCTGGTGGACAAGGTCCATACGGTCCTGGTGCTGGTC |
| 1475 | RM2925 | AACAGGGACCAGGTAGTCAAGGACCTGGTTCAGGTGGTCAGCAGGGTCCAG |
| 1476 | RM2926 | GAGGACAGGGTCCTTACGGCCCTTCTGCCGCTGCAGCAGCAGCCGCTG |
| 1477 | RM2927 | CCGCAGGAGGATACGGACCTGGTGCTGGACAACGATCTCAAGGACCAGG |
| 1478 | RM2928 | AGGACAAGGTCCTTATGGACCTGGCGCTGGCCAACAAGGACCTGGTTCT |
| 1479 | RM2929 | CAGGGTCCAGGTTCAGGAGGCCAACAAGGCCCAGGAGGTCAAGGACCAT |
| 1480 | RM2930 | ACGGACCATCCGCTGCGGCAGCTGCAGCTGCTGCAGGTACGTCTTCATCGCTATCCTGCA |
| 1481 | RM2931 | ACTTCCTGGACCTTGTTGACCAGCGCCTGGACCGTAACCACCTTGAGACCATCGCTAAGG |
| 1482 | RM2932 | TGTTGGCCACTACCGTAGGGTCCTTGACCGCCAGGTCCTTGTTGACCACC |
| 1483 | RM2933 | CGTAAGGTCCTTGGCCTCCCGGACCCTGCTGTCCTGCTCCACCTGGACCT |
| 1484 | RM2934 | TCCTGGACCGTAACCTCCGGCAGCGGCAGCGGCGGCAGCAGCAGCACCTGGTC |
| 1485 | RM2935 | GATCCTGGACCTTGTTGTCCAGCTCCACCTGGACCCTGTTGTCCGGC |
| 1486 | RM2936 | CCTGTTGACCAGCACCAGGACCGTATGGACCTTGTCCACCAGGACCTTGT |
| 1487 | RM2937 | GTCCTCCTGGACCCTGCTGACCACCTGAACCAGGTCCTTGACTACCTGGTC |
| 1488 | RM2938 | CTGCGGCAGCGGCTGCTGCTGCAGCGGCAGAAGGGCCGTAAGGACCCT |
| 1489 | RM2939 | TGTCCTCCTGGTCCTTGAGATCGTTGTCCAGCACCAGGTCCGTATCCTC |
| 1490 | RM2940 | ACCCTGAGAACCAGGTCCTTGTTGGCCAGCGCCAGGTCCATAAGGACCT |
| 1491 | RM2941 | GTCCGTATGGTCCTTGACCTCCTGGGCCTTGTTGGCCTCCTGAACCTGG |
| 1492 | RM2942 | GGATAGCGATGAAGACGTACCTGCAGCAGCTGCAGCTGCCGCAGCGGATG | by combining 1 µl 10×NEB T4 DNA ligase buffer, 1 µl 100 µM pooled oligos, 1 µl NEB T4 Polynucleotide Kinase (10,000 U/ml), and 7 µl ddH2O and incubating for 1 hour at 37° C. The oligos were then annealed by mixing 4 µl of the phosphorylation reaction with 16 µl of ddH2O, heating the mixture to 95° C. for 5 minutes, and then cooling the mixture to 25° C. at a rate of 0.1° C./sec. The oligos were then ligated together into a vector by combining 4 µl of the annealed oligos with 5 nmol vector backbone (RM396 [SEQ ID NO: 1405], digested with AscI and SbfI), 1 µl NEB T4 DNA ligase (400,000 U/ml), 1 µl 10×NEB T4 DNA ligase buffer, and ddH2O to 10 µl. The ligation solution was incubated for 30 minutes at room temperature. The entirety of the ligation reaction was transformed into E. coli for clonal selection, Synthesis of RM410 Sequence:
Oligos RM2999-RM3014 (SEQ ID NOs: 1492-1507) in Table 4 were combined into a single mixture at a concentration of 100 µM of each oligo. The oligos were phosphorylated in a phosphorylation reaction prepared by combining 1 µl 10×NEB T4 DNA ligase buffer, 1 µl 100 µM pooled oligos, 1 µl NEB T4 Polynucleotide Kinase (10,000 U/ml), and 7 µl ddH2O and incubating for 1 hour at 37° C. The oligos were then annealed by mixing 4 µl of the phosphorylation reaction with 16 µl of ddH2O, heating the mixture to 95° C. for 5 minutes, and then cooling the mixture to 25° C. at a rate of 0.1° C./sec. The oligos were then ligated together into a vector by combining 4 µl of the annealed oligos with 5 nmol vector backbone (RM400 [SEQ ID NO: 1406], digested with AscI and SbfI), 1 µl NEB T4 DNA ligase (400,000 U/ml), 1 µl 10×NEB T4 DNA ligase buffer, and ddH2O to 10 µl. The ligation solution was incubated for 30 minutes at room temperature. The entirety of the ligation reaction was transformed into E. coli for clonal selection, plasmid isolation, and sequence verification according to known techniques.

The resulting oligonucleotide has a 5' to 3' nucleotide sequence of SEQ ID NO: 931 and is identified as RM410.

lin (AmpR). The order (relative position) of the resistance genes matters, such that AmpR/KanR is distinct from KanR/AmpR for the purpose of DNA assembly. The 6 assembly vectors are shown in Table 5, are named based on the two resistance markers in each (C for CamR, K for KanR, and A for AmpR). The 6 assembly vectors are as follows: KC (RM396, SEQ ID NO:1402), KA (RM397, SEQ ID NO:1403), AC (RM398, SEQ ID NO:1404), AK (RM399,

TABLE 4

Oligo sequences for generating RM410 silk repeat domain (with flanking sequences for cloning) (SEQ ID NO: 931)

| SEQ ID NO: | ID | 5' to 3' Nucleotide Sequence |
|---|---|---|
| 1493 | RM2999 | CGCGCCTTAGCGATGGTCTCAAGGTGGATATGGCCCAGGAGCCGGACAACAGGGTCCT |
| 1494 | RM3000 | GGTTCACAAGGTCCAGGATCTGGTGGTCAACAGGGACCAGGCGGCCAGGGAC |
| 1495 | RM3001 | CTTATGGTCCAGGAGCCGCTGCAGCAGCAGCAGCTGTTGGAGGTTACGGCC |
| 1496 | RM3002 | CTGGTGCCGGTCAACAAGGCCCAGGATCTCAGGGTCCTGGATCTGGAGGAC |
| 1497 | RM3003 | AACAAGGTCCTGGAGGTCAGGGTCCATACGGACCTTCAGCAGCAGCTGCTGC |
| 1498 | RM3004 | TGCAGCCGCTGGTGGTTATGGACCTGGTGCTGGTCAACAAGGACCGGGTT |
| 1499 | RM3005 | CTCAGGGTCCGGGTTCAGGAGGTCAGCAGGGCCCTGGTGGACAAGGACCTT |
| 1500 | RM3006 | ATGGACCTAGTGCGGCTGCAGCAGCTGCCGCCGCAGGTACGTCTTCATCGCTATCCTGCA |
| 1501 | RM3007 | TGAACCAGGACCCTGTTGTCCGGCTCCTGGGCCATATCCACCTTGAGACCATCGCTAAGG |
| 1502 | RM3008 | CATAAGGTCCCTGGCCGCCTGGTCCCTGTTGACCACCAGATCCTGGACCTTG |
| 1503 | RM3009 | CACCAGGGCCGTAACCTCCAACAGCTGCTGCTGCTGCAGCGGCTCCTGGAC |
| 1504 | RM3010 | CTTGTTGTCCTCCAGATCCAGGACCCTGAGATCCTGGGCCTTGTTGACCGG |
| 1505 | RM3011 | GCTGCAGCAGCAGCTGCTGCTGAAGGTCCGTATGGACCCTGACCTCCAGGAC |
| 1506 | RM3012 | CCTGAGAACCCGGTCCTTGTTGACCAGCACCAGGTCCATAACCACCAGCG |
| 1507 | RM3013 | GTCCATAAGGTCCTTGTCCACCAGGGCCCTGCTGACCTCCTGAACCCGGAC |
| 1508 | RM3014 | GGATAGCGATGAAGACGTACCTGCGGCGGCAGCTGCTGCAGCCGCACTAG |

Assembly and Assay of Argiope bruennichi MaSp2, "18B"

Figure 6:
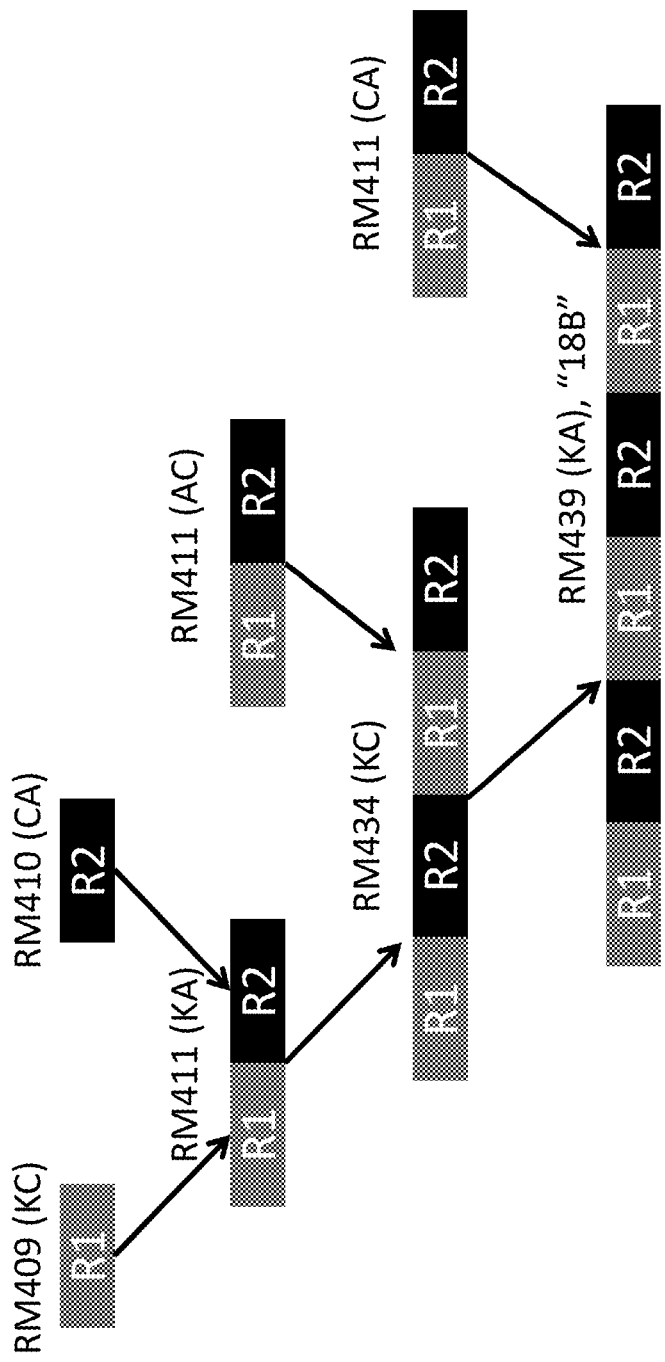
FIG. 6 depicts assembly of a block copolymer 18B silk polynucleotide from repeat sequences R1, R2, according to an embodiment of the invention.

RM409 (SEQ ID NO: 930) and RM410 (SEQ ID NO: 931) oligonucleotide sequences synthesized according to the method described above were assembled according to the diagram shown in FIG. 6 to generate RM439 silk nucleotide sequence (e.g., "18B").

Figure 7:
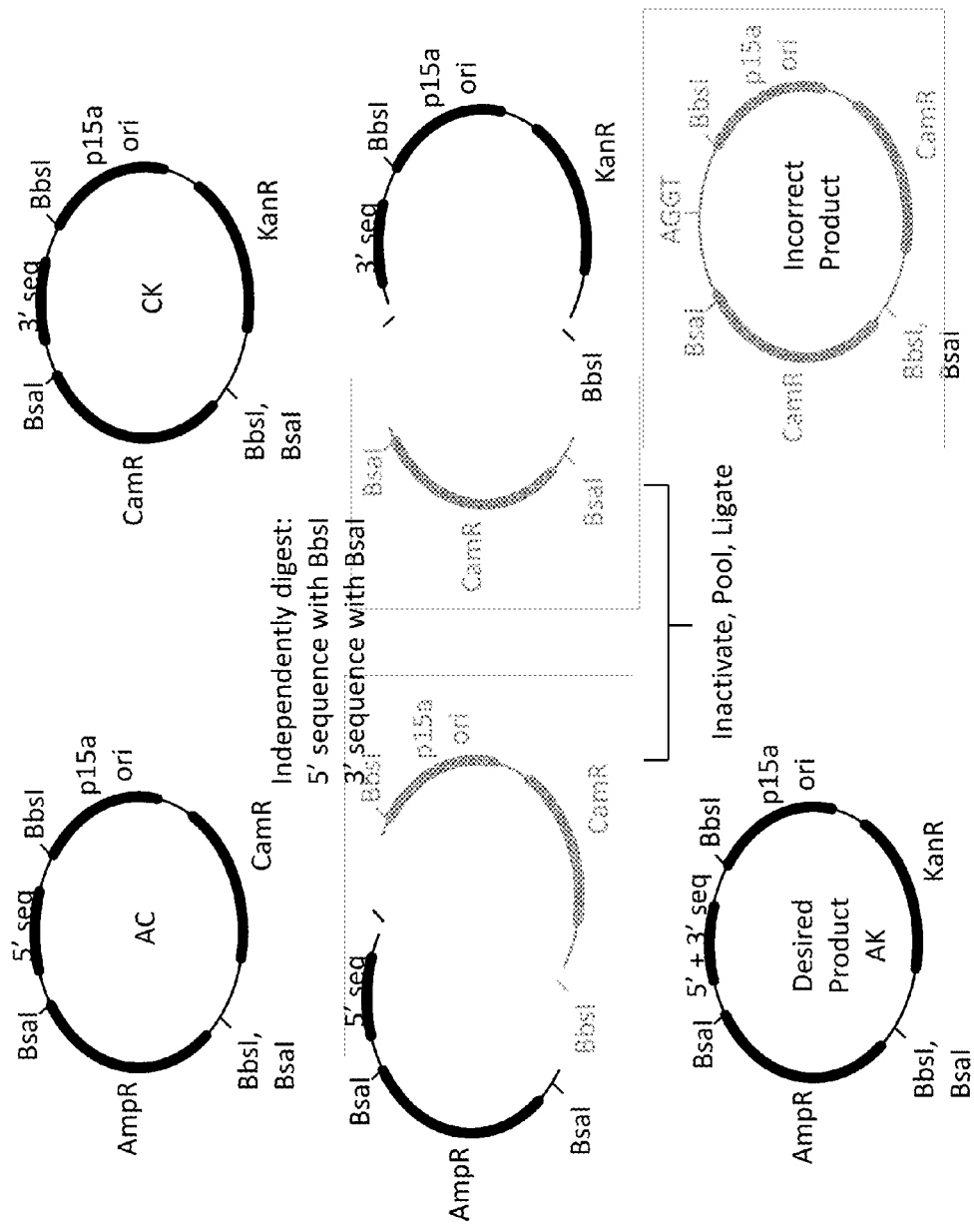
FIG. 7 depicts assembly vectors used to assemble silk polynucleotide segments, according to an embodiment of the invention.
Figure 8:
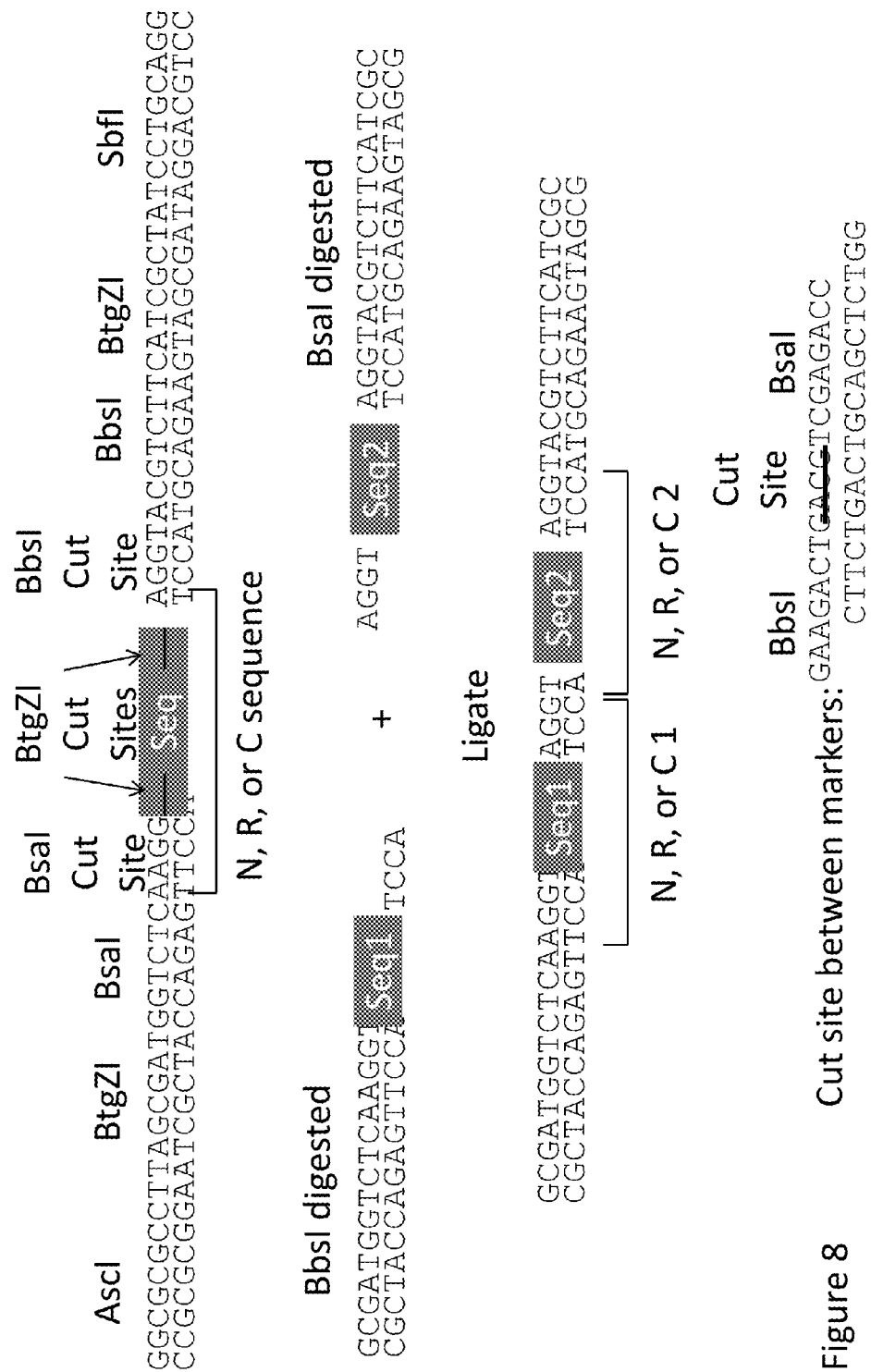
FIG. 8 shows ligation of 2 sequences to form a part of a silk polynucleotide sequence, according to an embodiment of the invention.

RM409 (SEQ ID NO: 930) and RM410 (SEQ ID NO: 931) in assembly vectors were digested and ligated according to the diagrams shown in FIG. 7 and FIG. 8. Silk N, R, and C domains, as well as additional elements including the alpha mating factor pre-pro sequence and a 3× FLAG tag, were assembled using a pseudo-scarless 2 antibiotic (2ab) method (Leguia, M., et al., 2ab assembly: a methodology for automatable, high-throughput assembly of standard biological parts, J. Biol. Eng., 7:1 (2013); and Kodumal, S. J., et al., Total synthesis of long DNA sequences: synthesis of a contiguous 32-kb polyketide synthase gene cluster, Proc. Natl. Acad. Sci. U.S.A., 101:44, pg. 15573-15578 (2004)).

2ab assembly relies on the use of 6 assembly vectors that are identical except for the identity and relative position of 2 selectable markers. Each vector is resistant to exactly 2 of: chloramphenicol (CamR), kanamycin (KanR), and ampicil- SEQ ID NO:1405), CA (RM400, SEQ ID NO:1406), and CK (RM401, SEQ ID NO:1407). Assembly vectors are shown in Table 5. Sequences for the vectors include those of SEQ ID NOs: 1399-1410.

TABLE 5

Expression and assembly vectors

| Vector ID | Vector Type | Description | SEQ ID NO: |
|---|---|---|---|
| RM618 | Expression Vector (dummy insert) | circular, double stranded DNA | 1399 |
| RM652 | Expression Vector (dummy insert) | circular, double stranded DNA | 1400 |
| RM468 | Expression Vector (dummy insert) | circular, double stranded DNA | 1401 |
| RM396 | Assembly Vector (dummy insert) | circular, double stranded DNA | 1402 |
| RM397 | Assembly Vector (dummy insert) | circular, double stranded DNA | 1403 |
| RM398 | Assembly Vector (dummy insert) | circular, double stranded DNA | 1404 |
| RM399 | Assembly Vector (dummy insert) | circular, double stranded DNA | 1405 |
| RM400 | Assembly Vector (dummy insert) | circular, double stranded DNA | 1406 |

TABLE 5-continued

Expression and assembly vectors

| Vector ID | Vector Type | Description | SEQ ID NO: |
|---|---|---|---|
| RM401 | Assembly Vector (dummy insert) | circular, double stranded DNA | 1407 |
| RM529 | Assembly Vector, alpha mating factor special case | circular, double stranded DNA | 1408 |

FIG. 7 shows a single assembly reaction performed with two compatible vectors, AC (RM398 SEQ ID NO:1404) and CK (RM401 SEQ ID NO:1407), one containing a sequence destined for the 5' end of the target composite sequence and one destined for the 3' end of the target composite sequence. The plasmid bearing the 5' sequence is independently digested with BbsI, while the plasmid bearing the 3' sequence is independently digested with BsaI.

After inactivation of the enzymes, the two digested plasmids are pooled and ligated. The desired product resides in an AK vector, which is distinct from all input vectors and undesired byproducts. This enables selection for the desired product after transformation into E. coli.

The DNA sequence of the cloning sites during this process is shown in FIG. 8. By selecting the 4 bp overhang generated by the type IIs enzymes to be AGGT, assembly of DNA fragments generates scarless junctions in the desired encoded polypeptide provided that the polypeptide starts with a glycine (coded by GGT) and terminates with a codon ending in an A (all except F, Y, W, C, H, N, M, and D).

The assembly of RM409 (SEQ ID NO: 930) and RM410 (SEQ ID NO: 931) in KC and CA assembly vectors, respectively, generated RM411 (SEQ ID NO: 465) in KA, as shown in FIG. 6. The RM411 (SEQ ID NO: 465) sequence was transferred to AC and CA using AscI and SbfI. The RM411 (SEQ ID NO: 465) KA and AC sequences were digested and ligated according to the procedure described above to generate RM434 (SEQ ID NO: 466) in KC. Finally, RM434 (SEQ ID NO: 466) in KC was digested and ligated with RM411 (SEQ ID NO: 465) in CA to generate the final silk polypeptide coding sequence, RM439 (SEQ ID NO: 467) (aka, "18B").

Transfer of "18B" Silk Polypeptide Coding Sequence (RM439) to the RM468 Expression Vector:

The RM468 (SEQ ID NO: 1401) expression vector contains an alpha mating factor sequence and a 3× FLAG sequence (SEQ ID NO: 1409). The 18B silk polypeptide coding sequence RM439 (SEQ ID NO: 467) was transferred to the RM468 (SEQ ID NO: 1401) expression vector via BtgZI restriction enzymes and Gibson reaction kits. The RM439 vector was digested with BtgZI, and the polynucleotide fragment containing the silk sequence isolated by gel electrophoresis. The expression vector, RM468, exclusive of an unwanted dummy insert, was amplified by PCR using primers RM3329 and RM3330, using the conditions described in Example 4. The resulting PCR product and isolated silk fragment were combined using a Gibson reaction kit according to the manufacturers instructions. Gibson reaction kits are commercially available (https://www.neb.com/products/e2611-gibson-assembly-master-mix), and are described in a U.S. Pat. No. 5,436,149 and in Gibson, D. G. et al., Enzymatic assembly of DNA molecules up to several hundred kilobases, Nat. Methods, 6:5, pg. 343-345 (2009).

The resulting expression vector containing RM439 (SEQ ID NO: 467) was transformed into Pichia (Komagataella) pastoris. Clones of the resulting cells were cultured according to the following conditions: The culture was grown in a minimal basal salt media, similar to one described in [http://tools.invitrogen.com/content/sfs/manuals/pichiaferm_prot.pdf] with 50 g/L of glycerol as a starting feedstock. Growth was in a stirred fermentation vessel controlled at 30 C, with 1 VVM of air flow and 2000 rpm agitation. pH was controlled at 3 with the on-demand addition of ammonium hydroxide. Additional glycerol was added as needed based on sudden increases in dissolved oxygen. Growth was allowed to continue until dissolved oxygen reached 15% of maximum at which time the culture was harvested, typically at 200-300 OD of cell density.

Figure 9:
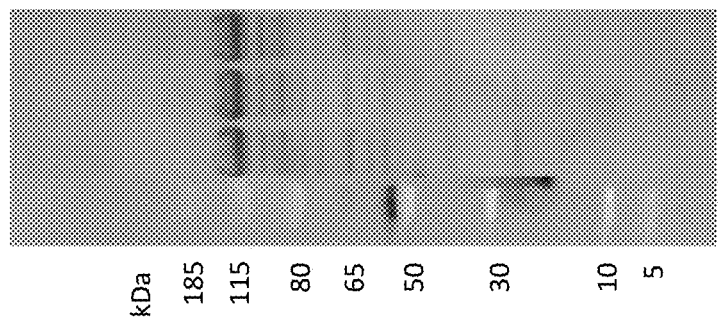
FIG. 9 is a western blot comprising block copolymer silk polypeptides isolated from a culture expressing an 18B silk polypeptide.

The broth from the fermenter was decellularized by centrifugation. The supernatant from the Pichia (Komagataella) pastoris culture was collected. Low molecular weight components were removed from the supernatant using ultrafiltration to remove particles smaller than the block copolymer polypeptides. The filtered culture supernatant was then concentrated up to 50×. The polypeptides in the supernatant were precipitated and analyzed via a western blot. The product is shown in the western blot in FIG. 9. The predicted molecular weight of processed 18B is 82 kDa. The product observed in the western blot in FIG. 9 exhibited a higher MW of ~120 kDa. While the source of this discrepancy is unknown, other silk polypeptides have been observed to appear at a higher than expected molecular weight.

Figure 10:
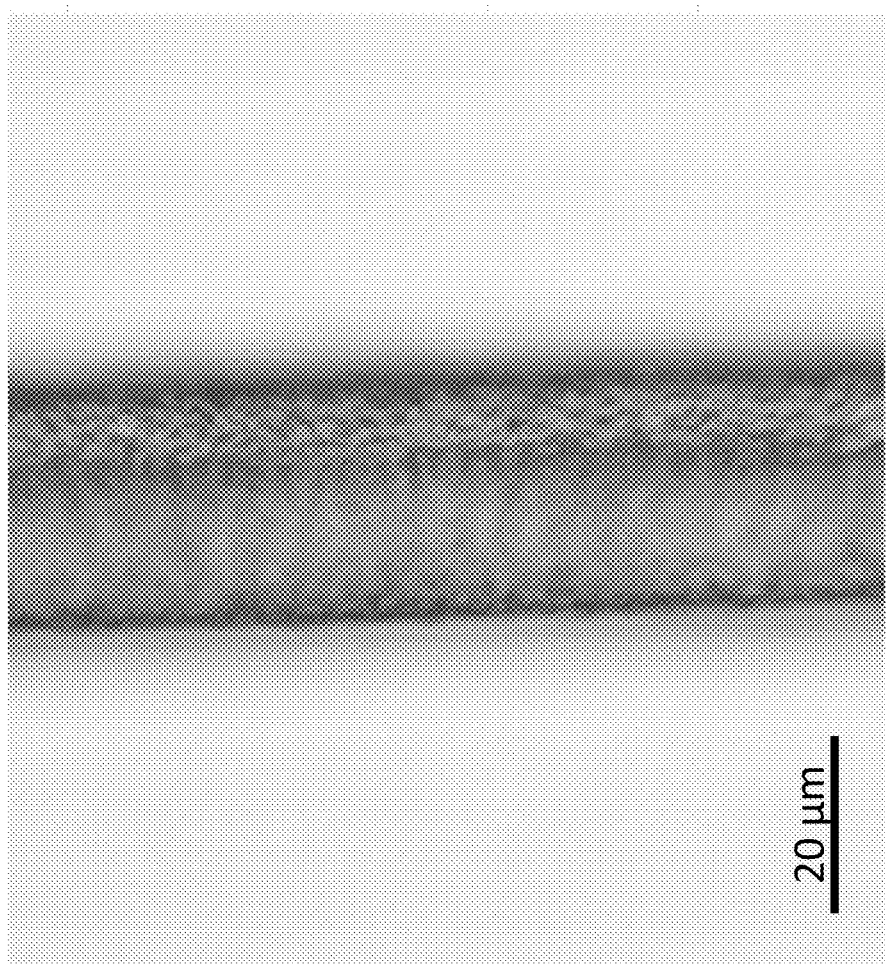
FIG. 10 is a light microscopy magnified view of a block copolymer fiber produced by methods described herein.

The 18B block copolymer polypeptide was purified and processed into a fiber spinnable solution. The fiber spinnable solution was prepared by dissolving the purified and dried polypeptide in a spinning solvent. The polypeptide is dissolved in the selected solvent at 20 to 30% by weight. The fiber spinnable solution was then extruded through a 150 micron diameter orifice into a coagulation bath comprising 90% methanol/10% water by volume. Fibers were removed from the coagulation and drawn from 1 to 5 times their length, and subsequently allowed to dry. The resulting fiber is shown in FIG. 10.

Figure 11:
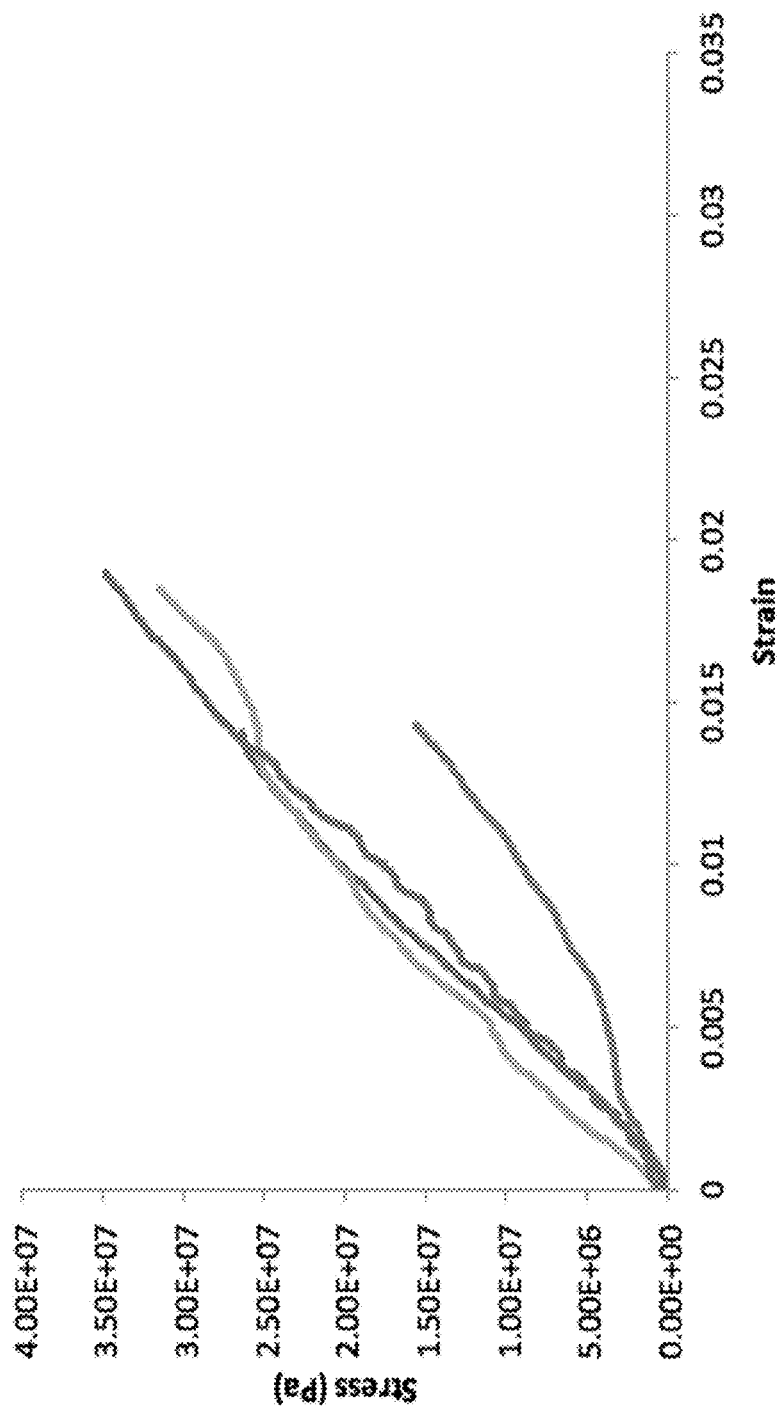
FIG. 11 shows a graph of stress v. strain for several block copolymer fibers produced according to methods described herein.

Mechanical testing was performed on the 18B block copolymer polypeptide that was secreted, purified, dissolved, and turned into a fiber as described above. Fibers were tested for mechanical properties on a custom-built tensile tester, using common processes. Test samples were mounted with a gauge length of 5.75 mm and tested at a strain rate of 1%. The resultant forces were normalized to the fiber diameter, as measured by microscopy. Results of stress vs strain are shown in FIG. 11 in which each stress-strain curve represents a replicate measurement from a fiber from a single spinning experiment, from a single batch.

Example 6

Assembly and Assay of 4× Repeat R Sequences

Figure 12:
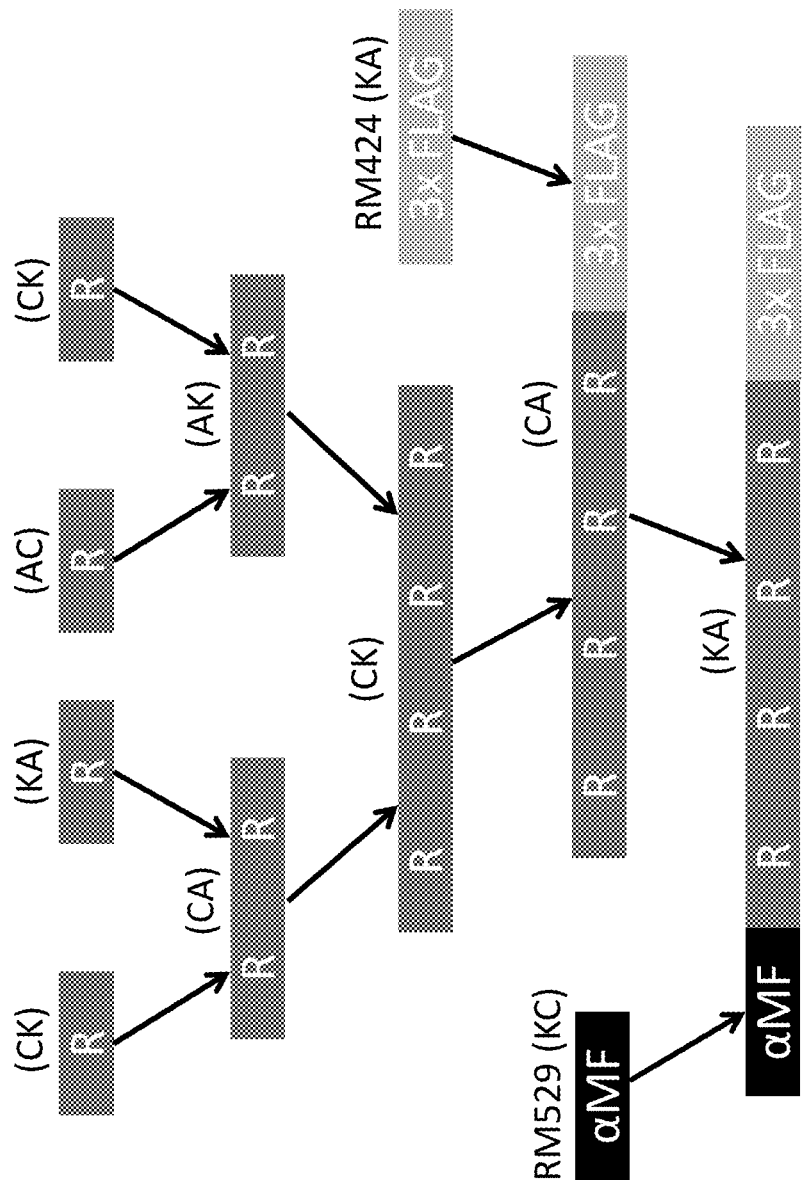
FIG. 12 is an assembly diagram of several silk R domains to form a block copolymer polynucleotide, according to an embodiment of the invention.
Figure 13:
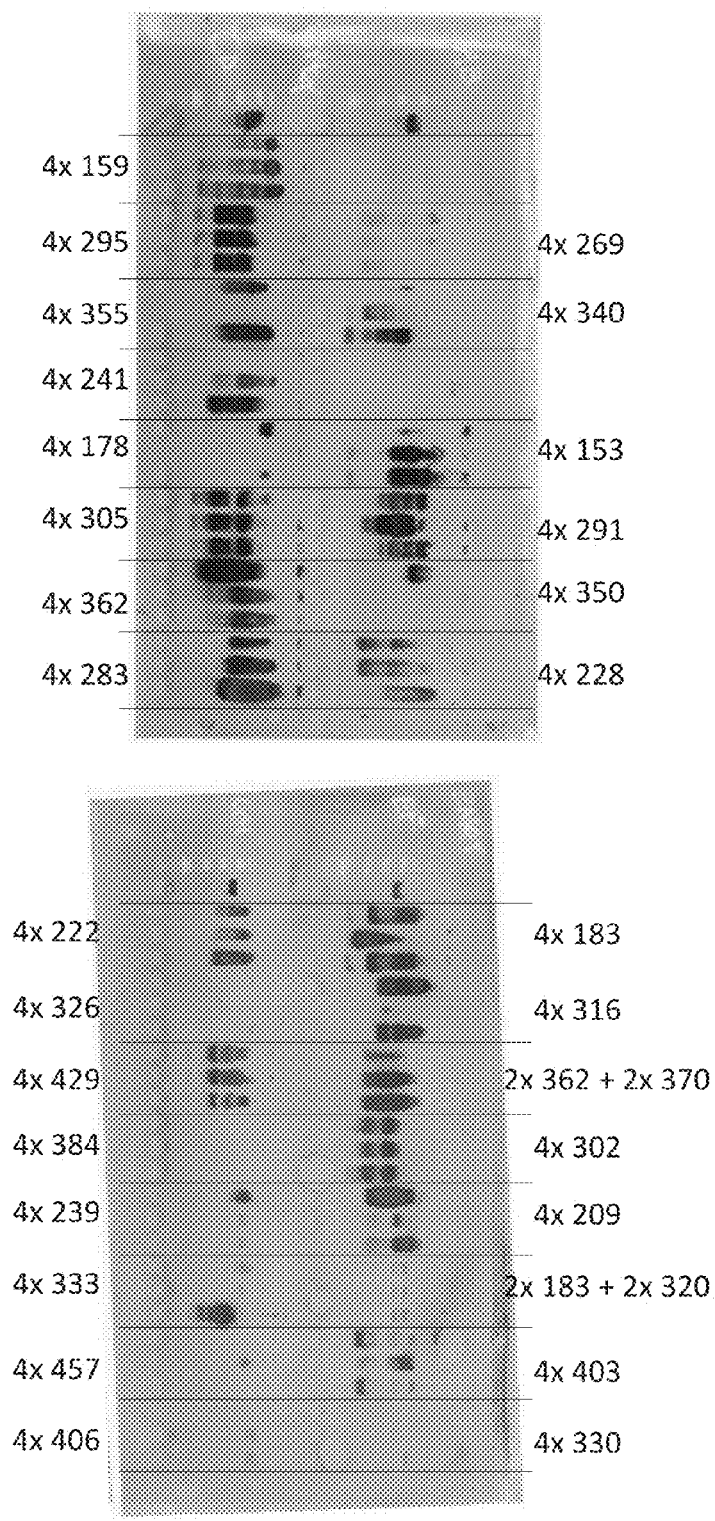
FIG. 13 shows a western blot of expressed block copolymer polypeptides each polypeptide being a concatemer of four copies of the indicated silk repeat sequences.

Selected R domains from SEQ ID NOs: 1-1398 that expressed and secreted well were concatenated into 4× repeat domains using the assembly scheme shown in FIG. 12. The concatenation was performed as described in Example 4 and shown in FIGS. 7 and 8. Selected sequences from this ligation of R sequences are shown in Table 6. Sequences for these silk constructs include those full-length silk construct sequences of SEQ ID NOs: 1411-1468. The resulting products comprising 4 repeat sequences, an alpha mating factor, and a 3× FLAG domain were digested with AscI and SbfI to release the desired silk sequence and ligated into expression vector RM652 (SEQ ID NO: 1400) that had been digested with AscI and SbfI to release an unwanted dummy insert. After clonal isolation from E. coli, vectors were then transformed into Pichia pastoris. Transformants were plated on YPD agar plates containing 25 μg/ml nourseothricin and incubated for 48 hours at 30° C. Three clones from each transformation were inoculated into 400 μl of BMGY in a 96-well square-well block, and incubated for 48 hours at 30° C. with agitation at 1000 rpm. Cells were pelleted via centrifugation, and the supernatant was recovered for analysis of block copolymer polypeptide content via western blot (FIG. 13). Of the 28 constructs transformed with 4× identical repeat sequences, most (18/28) had at least one clone with a substantial signal on the western blot, and only 1 showed no signal at all. Of two constructs composed of 2 repeats each of 2 distinct repeat sequences, one showed a strong western blot signal, while the other showed a modest western signal. This confirms that assembling larger block copolymer-expressing polynucleotides from smaller, well-expressed polynucleotides generally leads to functionally expressed block copolymer polypeptides. Streakiness, multiple bands, and clone-to-clone variation are evident on the western. While the specific source of these variations has not been identified, they are generally consistent with typically observed phenomena, including polypeptide degradation, post-translational modification (e.g., glycosylation), and clonal variation following genomic integration. Modified and degraded polypeptide products can be incorporated into fibers without adversely affecting the utility of the fibers depending on their intended use.

TABLE 6

Full length block copolymer silk constructs with alpha mating factor, 4X repeat domains, and 3X FLAG domains.

| Construct ID | R/N/C | Amino acid SEQ ID NO | Nucleotide SEQ ID NO: | Western Results (1 = no band 2 = weak band 3 = strong band) |
|---|---|---|---|---|
| 4x 269 | R | 1411 | 1440 | 2 |
| 4x 340 | R | 1412 | 1441 | 3 |
| 4x 153 | R | 1413 | 1442 | 3 |
| 4x 291 | R | 1414 | 1443 | 3 |
| 4x 350 | R | 1415 | 1444 | 3 |
| 4x 228 | R | 1416 | 1445 | 2 |
| 4x 159 | R | 1417 | 1446 | 3 |
| 4x 295 | R | 1418 | 1447 | 3 |
| 4x 355 | R | 1419 | 1448 | 3 |
| 4x 241 | R | 1420 | 1449 | 3 |
| 4x 178 | R | 1421 | 1450 | 3 |
| 4x 305 | R | 1422 | 1451 | 3 |
| 4x 362 | R | 1423 | 1452 | 2 |
| 4x 283 | R | 1424 | 1453 | 3 |
| 4x 183 | R | 1425 | 1454 | 3 |
| 4x 316 | R | 1426 | 1455 | 3 |
| 2x 362 + 2x 370 | R | 1509 | 2802 | 3 |
| 4x 302 | R | 1427 | 1456 | 3 |
| 4x 209 | R | 1428 | 1457 | 3 |
| 2x 183 + 2x 320 | R | 1511 | 1510 | 2 |
| 4x 403 | R | 1430 | 1459 | 3 |
| 4x 330 | R | 1431 | 1460 | 2 |
| 4x 222 | R | 1432 | 1461 | 3 |
| 4x 326 | R | 1433 | 1462 | 2 |
| 4x 429 | R | 1434 | 1463 | 3 |
| 4x 384 | R | 1435 | 1464 | 1 |
| 4x 239 | R | 1436 | 1465 | 2 |
| 4x 333 | R | 1437 | 1466 | 3 |
| 4x 457 | R | 1438 | 1467 | 2 |
| 4x 406 | R | 1439 | 1468 | 2 |

Example 7

Expression of 18B from *Bacillus subtilis*

An *E. coli/B. subtilis* shuttle and expression plasmid is first constructed. The polynucleotide encoding 18B is transferred, using a Gibson reaction, to plasmid pBE-S (Takara Bio Inc.). Plasmid pBE-S (SEQ ID NO: 1512) is amplified using primers BES-F (5'-AAGACGATGACGATAAGGAC-TATAAAGATGATGACGACAAATAATGCGGTAGTT TATCAC-3') (SEQ ID NO: 2831) and BES-R (5'-CCA-GCGCCTGGACCGTAACCCGGCCGCAGCCTGCGCA-GACATGTTGCTGAACGC CATCGT-3') (SEQ ID NO: 2832) in a PCR reaction. The reaction mixture consists of 1 μl of 10 μM BES-F, 1 μl of 10 μM BES-R, 0.5 μg of pBE-S DNA (in 1 μl volume), 22 μl of deionized H2O, and 25 μl of Phusion High-Fidelity PCR Master Mix (NEB catalog M0531S). The mixture is thermocycled according to the following program:
1) Denature for 5 minutes at 95° C.
2) Denature for 30 seconds at 95° C.
3) Anneal for 30 seconds at 55° C.
4) Extend for 6 minutes at 72° C.
5) Repeat steps 2-4 for 29 additional cycles
6) Perform a final extension for 5 minutes at 72° C.

The product is subjected to gel electrophoresis, and the product of approximately 6000 bp is isolated, then extracted using a Zymoclean Gel DNA Recovery Kit (Zymo Research) according to the manufacturer's instructions. The polynucleotide encoding 18B is isolated by digestion of 18B in the KA assembly vector using restriction enzyme BtgZI, followed by gel electrophoresis, fragment isolation, and gel extraction. The pBE-S and 18B fragments are joined together using Gibson Assembly Master Mix (New England Biolabs) according to the manufacturer's instructions, and the resulting plasmid transformed into *E. coli* using standard techniques for subsequent clonal isolation, DNA amplification, and DNA purification. The resulting plasmid, pBE-S-18B (SEQ ID NO: 1513), is then diversified by insertion of various signal peptides (the "SP DNA mixture") according to the manufacturer's instructions. A mixture of pBE-S-18B plasmids containing different secretion signal peptides is then transformed into *B. subtilis* strain RIK1285 according to the manufacturer's instructions. 96 of the resulting colonies are incubated in TY medium (10 g/L tryptone, 5 g/L yeast extract, 5 g/L NaCl) for 48 hours, at which point the cells are pelleted and the supernatant is analyzed by western blot for expression of the 18B polypeptide.

Example 8

Expression of 18B from *Chlamydomonas reinhardtii*

An *E. coli* vector bearing an excisable *C. reinhardtii* expression cassette, pChlamy (SEQ ID NO: 1514), is first constructed using commercial DNA synthesis and standard techniques. The cassette is described in detail in Rasala, B. A., Robust expression and secretion of Xylanase1 in *Chlamydomonas reinhardtii* by fusion to a selection gene and processing with the FMDV 2A peptide, *PLoS One*, 7:8 (2012). The polypeptide encoding 18B, a 3× FLAG tag, and a stop codon is reverse translated using the codon preference of *C. reinhardtii* (available, for example, at http://www.kazusa.or.jp/codon/cgi-bin/showcodon.cgi?species=3055) and synthesized using commercial synthesis. During synthesis, flanking BbsI sites are included to allow release of the 18B-3× FLAG polynucleotide. The polynucleotide resulting from PCR amplification of the pChlamy plasmid using primers designed to generate a linear fragment including the entire plasmid sequence except 5'-ATGTTTTAA-3' and also including 40 bp of homology to the 18B-3× FLAG coding sequence on each end is joined with the 18B-3× FLAG polynucleotide liberated by digestion with BbsI using a Gibson reaction, and transformed into *E. coli* for clonal selection, DNA amplification, and plasmid isolation. The resulting plasmid is digested with BsaI to release the 18B expression cassette, which is isolated by gel purification. The digested fragment is electroporated into strain cc3395, which is then selected on 15 μg/ml zeocin. Several clones are grown up in liquid culture, the cells pelleted by centrifugation, and the supernatant analyzed by western blot for protein expression.

Example 9

Additional Silk and Silk-Like Sequences

Additional silk and silk-like sequences and partial sequences were obtained from NCBI's sequence database by search for the term "silk" while excluding "spidroin" "*bombyx*" and "*latrodectus*". A subset of the resulting nucleotide sequences were translated into amino acid sequences, then curated to remove repeated sequences. Short sequences, generally less than 200-500 amino acids long, were removed. Further, primary sequences for select polypeptides known to form structural elements were obtained from public databases. Amino acid sequences so obtained, in addition to the sequences described in Example 1, were used to search for additional silk and silk-like sequences by homology. Resulting silk and silk-like sequences were curated, then partitioned into repetitive and non-repetitive regions.

Repetitive polypeptide sequences (repeat (R) sequences) were selected from each silk sequence and include SEQ ID NOs: 2157-2690 (SEQ ID NOs: 2157-2334 are nucleotide sequences, SEQ ID NOs: 2335-2512 are nucleotide sequences with flanking sequences for cloning, and SEQ ID NOs: 2513-2690 are amino acid sequences). Some of the R sequences have been altered, e.g., by addition of a serine to the C terminus to avoid terminating the sequence with an F, Y, W, C, H, N, M, or D amino acid. This allows for incorporation into the vector system described above. Incomplete blocks may also have been altered by incorporation of segments from a homologous sequence from another block.

Non-repetitive N terminal domain sequences (N sequences) and C terminal domain sequences (C sequences) were also selected from some silk and silk-like sequences (SEQ ID NOs: 2157-2690). The N terminal domain sequences were altered by removal of the leading signal sequence and, if not already present, addition of an N-terminal glycine residue. In some cases, the N and/or C domains were not separated from the R sequence(s) before further processing. R, N, and C amino acid sequences were reverse translated to nucleotide sequences as described in Example 2. The resulting nucleotide sequences were flanked with the following sequences during synthesis to enable cloning:

5'-GAAGACTTAA-SILK-GGTACGTCTTC-3' (SEQ ID NOS 2833 and 2826) where "SILK" is a polynucleotide sequence selected according to the teachings above.

Resulting linear DNA was digested with BbsI and ligated into vector RM747 (SEQ ID NO: 2696) which had been digested with BsmBI to release a dummy insert. Ligated material was transformed into *E. coli* for clonal isolation, DNA amplification, and sequence verification using standard methods. Resulting plasmids were digested with BsaI and BbsI, and the fragment encoding a silk or silk-like polypeptide isolated by gel electrophoresis, fragment excision, and gel extraction. The fragment was subsequently ligated into Expression Vector RM1007 (SEQ ID NO: 2707) which had been digested with BsmBI and treated with Calf Intestinal Alkaline Phosphatase. Ligated material was transformed into *E. coli* for clonal isolation, DNA amplification, and sequence verification using standard methods.

Expression vectors containing R, N, and/or C sequences were transformed into *Pichia* (*Komagataella*) *pastoris* (strain RMs71, described in Example 3) using the PEG method (Cregg, J. M. et al., DNA-mediated transformation, *Methods Mol. Biol.*, 389, pg. 27-42 (2007)). The expression vector consisted of a targeting region and promoter (pGAP), a dominant resistance marker (nat-conferring resistance to nourseothricin), a secretion signal (alpha mating factor leader and pro sequence), a C-terminal 3× FLAG epitope, and a terminator (pAOX1 pA signal).

Transformants were plated on Yeast Extract Peptone Dextrose Medium (YPD) agar plates containing 25 μg/ml nourseothricin and incubated for 48 hours at 30° C. Two clones from each transformation were inoculated into 400 μl of Buffered Glycerol-complex Medium (BMGY) in a 96-well square-well block, and incubated for 48 hours at 30° C. with agitation at 1000 rpm. Cells were pelleted via centrifugation, and the supernatant was recovered for analysis of block copolymer polypeptide content via western blot analysis of the 3× FLAG epitope.

Figure 14:
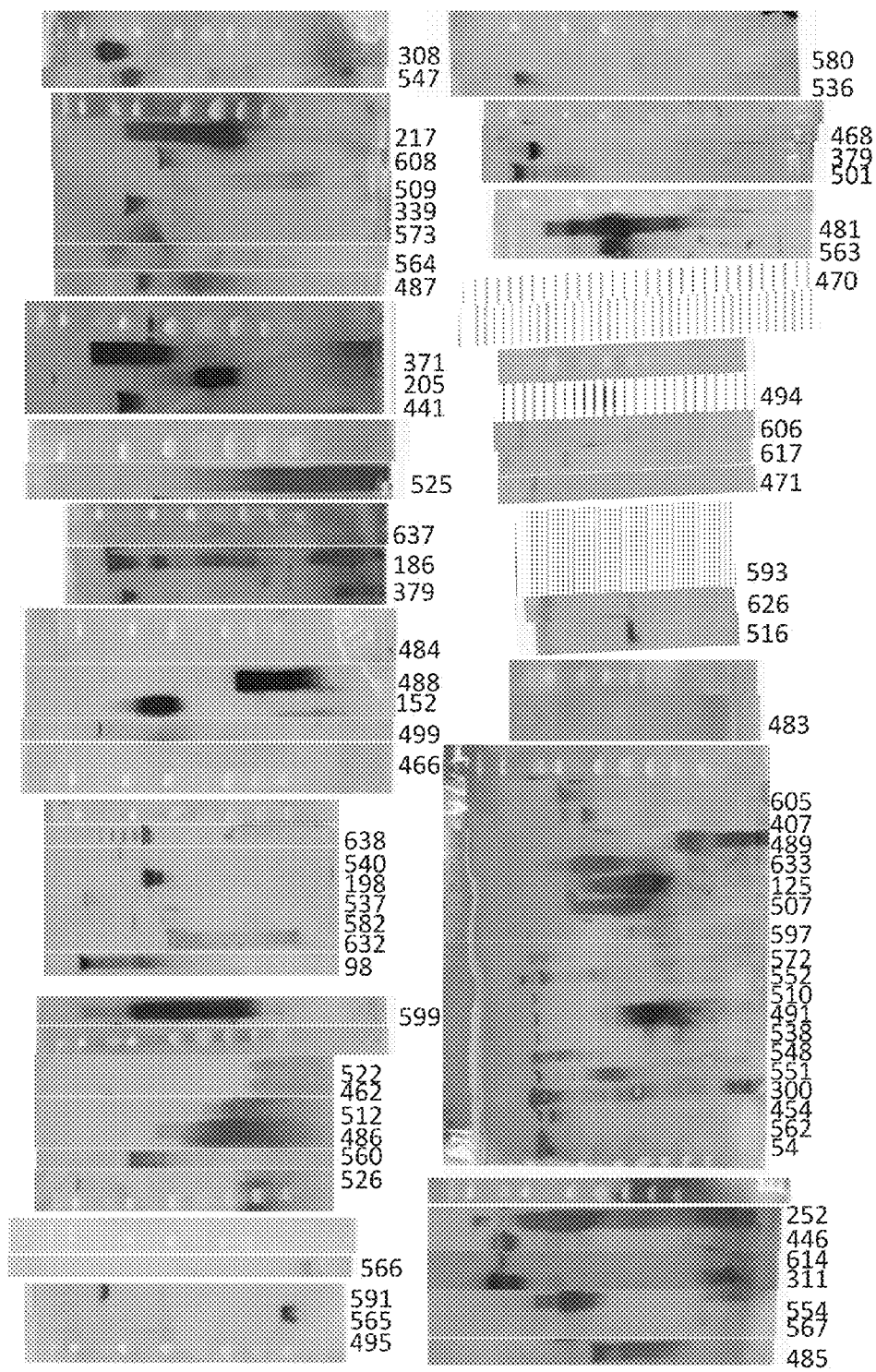
FIG. 14 shows representative western blots of additional expressed block copolymer polypeptides built using silk repeat sequences and expressed silk terminal domain sequences.

Successful polypeptide expression and secretion was judged by western blot. Each western lane was scored as 1: No band 2: Moderate band or 3: Intense band. The higher of the two scores for each clone was recorded. Representative western blot data are shown in FIG. 14. A complete listing of all R, N, and C sequences tested along with western blot results is shown in Table 7. Silk and silk-like block copolymer polypeptides from numerous species expressed successfully, encompassing diverse species and diverse polypeptide structures.

A number of embodiments of the invention have been described. Nevertheless, it will be understood that various modifications may be made without departing from the spirit and scope of the invention.

TABLE 7

Additional silk polypeptide sequences

| Construct # | Species | N/C/R sequence | Nucleotide SEQ ID NO | Nucleotide with flanking sequences SEQ ID NO: | Amino Acid SEQ ID NO: | Western Results (1 = no band 2 = weak band 3 = strong band) |
|---|---|---|---|---|---|---|
| 463 | Ceratitis capitata | R | 2157 | 2335 | 2513 | no data |
| 464 | Archimantis monstrosa | NRC | 2158 | 2336 | 2514 | no data |
| 465 | Archimantis monstrosa | NRC | 2159 | 2337 | 2515 | no data |
| 466 | Pseudomantis albofimbriata | NRC | 2160 | 2338 | 2516 | 1 |
| 467 | Pseudomantis albofimbriata | NRC | 2161 | 2339 | 2517 | no data |
| 468 | Tenodera australasiae | NRC | 2162 | 2340 | 2518 | 2 |

TABLE 7-continued

Additional silk polypeptide sequences

| Construct # | Species | N/C/R sequence | Nucleotide SEQ ID NO | Nucleotide with flanking sequences SEQ ID NO: | Amino Acid SEQ ID NO: | Western Results (1 = no band 2 = weak band 3 = strong band) |
|---|---|---|---|---|---|---|
| 469 | Tenodera australasiae | NRC | 2163 | 2341 | 2519 | no data |
| 470 | Hydropsyche angustipennis | R | 2164 | 2342 | 2520 | 1 |
| 471 | Hydropsyche angustipennis | R | 2165 | 2343 | 2521 | no data |
| 472 | Hydropsyche angustipennis | N | 2166 | 2344 | 2522 | no data |
| 473 | Hydropsyche angustipennis | C | 2167 | 2345 | 2523 | no data |
| 474 | Hydropsyche sp. T20 | R | 2168 | 2346 | 2524 | no data |
| 475 | Rhyacophila obliterata | R | 2169 | 2347 | 2525 | no data |
| 476 | Rhyacophila obliterata | R | 2170 | 2348 | 2526 | no data |
| 477 | Rhyacophila obliterata | C | 2171 | 2349 | 2527 | no data |
| 478 | Rhyacophila obliterata | N | 2172 | 2350 | 2528 | no data |
| 479 | Limnephilus decipiens | R | 2173 | 2351 | 2529 | no data |
| 480 | Chironomus pallidivittatus | NRC | 2174 | 2352 | 2530 | no data |
| 481 | Chironomus pallidivittatus | R | 2175 | 2353 | 2531 | 3 |
| 482 | Chironomus pallidivittatus | R | 2176 | 2354 | 2532 | no data |
| 483 | Chironomus thummi | R | 2177 | 2355 | 2533 | 3 |
| 484 | Stenopsyche marmorata | R | 2178 | 2356 | 2534 | 1 |
| 485 | Mallada signata | R | 2179 | 2357 | 2535 | 3 |
| 486 | Mallada signata | N | 2180 | 2358 | 2536 | 3 |
| 487 | Mallada signata | C | 2181 | 2359 | 2537 | 3 |
| 488 | Mallada signata | R | 2182 | 2360 | 2538 | 3 |
| 489 | Mallada signata | R | 2183 | 2361 | 2539 | 3 |
| 490 | Mallada signata | N | 2184 | 2362 | 2540 | no data |
| 491 | Mallada signata | C | 2185 | 2363 | 2541 | 3 |
| 492 | Mallada signata | R | 2186 | 2364 | 2542 | no data |
| 493 | Haploembia solieri | R | 2187 | 2365 | 2543 | no data |
| 494 | Culex quinquefasciatus | R | 2188 | 2366 | 2544 | no data |
| 495 | Culex quinquefasciatus | R | 2189 | 2367 | 2545 | 1 |
| 496 | Oecophylla smaragdina | NRC | 2190 | 2368 | 2546 | no data |
| 497 | Oecophylla smaragdina | NRC | 2191 | 2369 | 2547 | no data |
| 498 | Oecophylla smaragdina | NRC | 2192 | 2370 | 2548 | no data |
| 499 | Oecophylla smaragdina | NRC | 2193 | 2371 | 2549 | 2 |
| 500 | Myrmecia forficata | NRC | 2194 | 2372 | 2550 | no data |
| 501 | Myrmecia forficata | NRC | 2195 | 2373 | 2551 | 2 |
| 502 | Myrmecia forficata | NRC | 2196 | 2374 | 2552 | no data |
| 503 | Myrmecia forficata | NRC | 2197 | 2375 | 2553 | no data |
| 504 | Bombus terrestris | NRC | 2198 | 2376 | 2554 | no data |
| 505 | Bombus terrestris | NRC | 2199 | 2377 | 2555 | no data |
| 506 | Bombus terrestris | NRC | 2200 | 2378 | 2556 | no data |
| 507 | Bombus terrestris | NRC | 2201 | 2379 | 2557 | 3 |
| 508 | Bombus terrestris | NRC | 2202 | 2380 | 2558 | no data |
| 509 | Vespa simillima xanthoptera | R | 2203 | 2381 | 2559 | 3 |
| 510 | Vespa simillima xanthoptera | R | 2204 | 2382 | 2560 | 2 |
| 511 | Vespa simillima xanthoptera | R | 2205 | 2383 | 2561 | no data |
| 512 | Vespa simillima xanthoptera | NRC | 2206 | 2384 | 2562 | 3 |
| 513 | Vespa simillima xanthoptera | NRC | 2207 | 2385 | 2563 | no data |
| 514 | Vespa simillima xanthoptera | NRC | 2208 | 2386 | 2564 | no data |
| 515 | Apis mellifera | NRC | 2209 | 2387 | 2565 | no data |
| 516 | Apis mellifera | NRC | 2210 | 2388 | 2566 | no data |
| 517 | Apis mellifera | NRC | 2211 | 2389 | 2567 | no data |
| 518 | Apis mellifera | NRC | 2212 | 2390 | 2568 | no data |
| 519 | Cotesia glomerata | R | 2213 | 2391 | 2569 | no data |
| 520 | Aposthonia gurneyi | R | 2214 | 2392 | 2570 | no data |
| 521 | Hilara sp. TDS-2007 | R | 2215 | 2393 | 2571 | no data |
| 522 | Hilara sp. TDS-2007 | R | 2216 | 2394 | 2572 | 1 |
| 523 | Hilara sp. TDS-2007 | R | 2217 | 2395 | 2573 | no data |
| 524 | Apotrechus illawarra | NRC | 2218 | 2396 | 2574 | no data |
| 525 | Apotrechus illawarra | R | 2219 | 2397 | 2575 | 3 |
| 526 | Cricula trifenestrata | R | 2220 | 2398 | 2576 | 2 |
| 527 | Antheraea yamamai | N | 2221 | 2399 | 2577 | no data |
| 528 | Antheraea yamamai | C | 2222 | 2400 | 2578 | no data |
| 529 | Antheraea yamamai | R | 2223 | 2401 | 2579 | no data |
| 530 | Antheraea yamamai | R | 2224 | 2402 | 2580 | no data |
| 531 | Antheraea yamamai | R | 2225 | 2403 | 2581 | no data |
| 532 | Antheraea yamamai | R | 2226 | 2404 | 2582 | no data |
| 533 | Antheraea pernyi | N | 2227 | 2405 | 2583 | no data |
| 534 | Antheraea pernyi | C | 2228 | 2406 | 2584 | no data |
| 535 | Antheraea pernyi | R | 2229 | 2407 | 2585 | no data |
| 536 | Antheraea pernyi | R | 2230 | 2408 | 2586 | 2 |
| 537 | Antheraea mylitta | R | 2231 | 2409 | 2587 | 2 |
| 538 | Saturnia japonica | N | 2232 | 2410 | 2588 | 2 |
| 539 | Saturnia japonica | R | 2233 | 2411 | 2589 | no data |
| 540 | Saturnia japonica | R | 2234 | 2412 | 2590 | 2 |
| 541 | Saturnia japonica | R | 2235 | 2413 | 2591 | no data |

TABLE 7-continued

Additional silk polypeptide sequences

| Construct # | Species | N/C/R sequence | Nucleotide SEQ ID NO | Nucleotide with flanking sequences SEQ ID NO: | Amino Acid SEQ ID NO: | Western Results (1 = no band 2 = weak band 3 = strong band) |
|---|---|---|---|---|---|---|
| 542 | Rhodinia fugax | N | 2236 | 2414 | 2592 | no data |
| 543 | Rhodinia fugax | R | 2237 | 2415 | 2593 | no data |
| 544 | Rhodinia fugax | R | 2238 | 2416 | 2594 | no data |
| 545 | Rhodinia fugax | R | 2239 | 2417 | 2595 | no data |
| 546 | Rhodinia fugax | R | 2240 | 2418 | 2596 | no data |
| 547 | Galleria mellonella | N | 2241 | 2419 | 2597 | 3 |
| 548 | Galleria mellonella | C | 2242 | 2420 | 2598 | 2 |
| 549 | Galleria mellonella | R | 2243 | 2421 | 2599 | no data |
| 550 | Galleria mellonella | R | 2244 | 2422 | 2600 | no data |
| 551 | Bombyx mori | N | 2245 | 2423 | 2601 | 3 |
| 552 | Bombyx mori | C | 2246 | 2424 | 2602 | 2 |
| 553 | Bombyx mori | R | 2247 | 2425 | 2603 | no data |
| 554 | Bombyx mori | R | 2248 | 2426 | 2604 | 2 |
| 555 | Bombyx mori | R | 2249 | 2427 | 2605 | no data |
| 556 | Anagasta kuehniella | N | 2250 | 2428 | 2606 | no data |
| 557 | Anagasta kuehniella | C | 2251 | 2429 | 2607 | no data |
| 558 | Anagasta kuehniella | R | 2252 | 2430 | 2608 | no data |
| 559 | Anagasta kuehniella | R | 2253 | 2431 | 2609 | no data |
| 560 | Antheraea pernyi | R | 2254 | 2432 | 2610 | 2 |
| 561 | Antheraea pernyi | C | 2255 | 2433 | 2611 | no data |
| 562 | Bacillus cereus | R | 2256 | 2434 | 2612 | 2 |
| 563 | Bacillus cereus | R | 2257 | 2435 | 2613 | 3 |
| 564 | Bacillus cereus | R | 2258 | 2436 | 2614 | 2 |
| 565 | Bacillus thuringiensis | R | 2259 | 2437 | 2615 | 2 |
| 566 | Bacillus licheniformis | R | 2260 | 2438 | 2616 | 2 |
| 567 | Bacillus licheniformis | R | 2261 | 2439 | 2617 | 1 |
| 568 | Neospora caninum | R | 2262 | 2440 | 2618 | no data |
| 569 | Danio rerio | R | 2263 | 2441 | 2619 | no data |
| 570 | Danio rerio | R | 2264 | 2442 | 2620 | no data |
| 571 | Danio rerio | R | 2265 | 2443 | 2621 | no data |
| 572 | Atta cephalotes | R | 2266 | 2444 | 2622 | 2 |
| 573 | Ureaplasma urealyticum | R | 2267 | 2445 | 2623 | 1 |
| 574 | Bombus terrestris | R | 2268 | 2446 | 2624 | no data |
| 575 | Bombus terrestris | R | 2269 | 2447 | 2625 | no data |
| 576 | Bombus impatiens | R | 2270 | 2448 | 2626 | no data |
| 577 | Bombus impatiens | R | 2271 | 2449 | 2627 | no data |
| 578 | Bombus impatiens | R | 2272 | 2450 | 2628 | no data |
| 579 | Bombus impatiens | R | 2273 | 2451 | 2629 | no data |
| 580 | Bombus impatiens | R | 2274 | 2452 | 2630 | 1 |
| 581 | Drosophila yakuba | R | 2275 | 2453 | 2631 | no data |
| 582 | Drosophila yakuba | R | 2276 | 2454 | 2632 | 2 |
| 583 | Pseudomonas syringae | R | 2277 | 2455 | 2633 | no data |
| 584 | Phytophthora infestans | R | 2278 | 2456 | 2634 | no data |
| 585 | Phytophthora sojae | R | 2279 | 2457 | 2635 | no data |
| 586 | Polysphondylium pallidum | R | 2280 | 2458 | 2636 | no data |
| 587 | Rhipicephalus pulchellus | R | 2281 | 2459 | 2637 | no data |
| 588 | Culex quinquefasciatus | R | 2282 | 2460 | 2638 | no data |
| 589 | Tribolium castaneum | R | 2283 | 2461 | 2639 | no data |
| 590 | Tribolium castaneum | R | 2284 | 2462 | 2640 | no data |
| 591 | Streptococcus pyogenes | R | 2285 | 2463 | 2641 | 2 |
| 592 | Candidatus Microthrix parvicella | R | 2286 | 2464 | 2642 | no data |
| 593 | Amphimedon queenslandica | R | 2287 | 2465 | 2643 | no data |
| 594 | Acyrthosiphon pisum | R | 2288 | 2466 | 2644 | no data |
| 595 | Acyrthosiphon pisum | R | 2289 | 2467 | 2645 | no data |
| 596 | Caenorhabditis brenneri | R | 2290 | 2468 | 2646 | no data |
| 597 | Caenorhabditis brenneri | R | 2291 | 2469 | 2647 | 2 |
| 598 | Burkholderia pseudomallei | R | 2292 | 2470 | 2648 | no data |
| 599 | Mustela putorius furo | R | 2293 | 2471 | 2649 | 3 |
| 600 | Candida parapsilosis | R | 2294 | 2472 | 2650 | no data |
| 601 | Candida parapsilosis | R | 2295 | 2473 | 2651 | no data |
| 602 | Candida parapsilosis | R | 2296 | 2474 | 2652 | no data |
| 603 | Paenibacillus sp | R | 2297 | 2475 | 2653 | no data |
| 604 | Xenopus (Silurana) tropicalis | R | 2298 | 2476 | 2654 | no data |
| 605 | Xenopus (Silurana) tropicalis | R | 2299 | 2477 | 2655 | 2 |
| 606 | Anopheles darlingi | R | 2300 | 2478 | 2656 | no data |
| 607 | Anopheles darlingi | R | 2301 | 2479 | 2657 | no data |
| 608 | Drosophila melanogaster | R | 2302 | 2480 | 2658 | 2 |
| 609 | Drosophila melanogaster | R | 2303 | 2481 | 2659 | no data |
| 610 | Synechococcus phage P60 | R | 2304 | 2482 | 2660 | no data |
| 611 | Amblyomma variegatum | R | 2305 | 2483 | 2661 | no data |
| 612 | Kazachstania naganishii | R | 2306 | 2484 | 2662 | no data |
| 613 | Drosophila ananassae | R | 2307 | 2485 | 2663 | no data |
| 614 | Tetrapisispora blattae | R | 2308 | 2486 | 2664 | 2 |

TABLE 7-continued

Additional silk polypeptide sequences

| Construct # | Species | N/C/R sequence | Nucleotide SEQ ID NO | Nucleotide with flanking sequences SEQ ID NO: | Amino Acid SEQ ID NO: | Western Results (1 = no band 2 = weak band 3 = strong band) |
|---|---|---|---|---|---|---|
| 615 | Tetrapisispora blattae | R | 2309 | 2487 | 2665 | no data |
| 616 | Monodelphis domestica | R | 2310 | 2488 | 2666 | no data |
| 617 | Amblyomma variegatum | R | 2311 | 2489 | 2667 | no data |
| 618 | Amblyomma variegatum | R | 2312 | 2490 | 2668 | no data |
| 619 | Latrodectus hesperus | R | 2313 | 2491 | 2669 | no data |
| 620 | Danaus plexippus | R | 2314 | 2492 | 2670 | no data |
| 621 | Encephalitozoon intestinalis | R | 2315 | 2493 | 2671 | no data |
| 622 | Encephalitozoon intestinalis | R | 2316 | 2494 | 2672 | no data |
| 623 | Psychromonas ingrahamii | R | 2317 | 2495 | 2673 | no data |
| 624 | Drosophila melanogaster | R | 2318 | 2496 | 2674 | no data |
| 625 | Chironomus tentans | R | 2319 | 2497 | 2675 | no data |
| 626 | Acyrthosiphon pisum | R | 2320 | 2498 | 2676 | 1 |
| 627 | Megachile rotundata | R | 2321 | 2499 | 2677 | no data |
| 628 | Megachile rotundata | R | 2322 | 2500 | 2678 | no data |
| 629 | Acyrthosiphon pisum | R | 2323 | 2501 | 2679 | no data |
| 630 | Pseudomonas syringae | R | 2324 | 2502 | 2680 | no data |
| 631 | Nematostella vectensis | R | 2325 | 2503 | 2681 | no data |
| 632 | Dasypus novemcinctus | R | 2326 | 2504 | 2682 | 3 |
| 633 | Trichoderma harzianum | R | 2327 | 2505 | 2683 | 3 |
| 634 | Nematostella vectensis | R | 2328 | 2506 | 2684 | no data |
| 635 | Nematostella vectensis | R | 2329 | 2507 | 2685 | no data |
| 636 | Caenorhabditis elegans | R | 2330 | 2508 | 2686 | no data |
| 637 | Leishmania mexicana | R | 2331 | 2509 | 2687 | no data |
| 638 | Chelonia mydas | R | 2332 | 2510 | 2688 | 2 |
| 639 | Nasonia vitripennis | R | 2333 | 2511 | 2689 | no data |
| 640 | Euprymna scolopes | NRC | 2334 | 2512 | 2690 | no data |

Example 10

Circularly Permuted Variants of *Argiope bruennichi* MaSp2 Polypeptides

Figure 15:
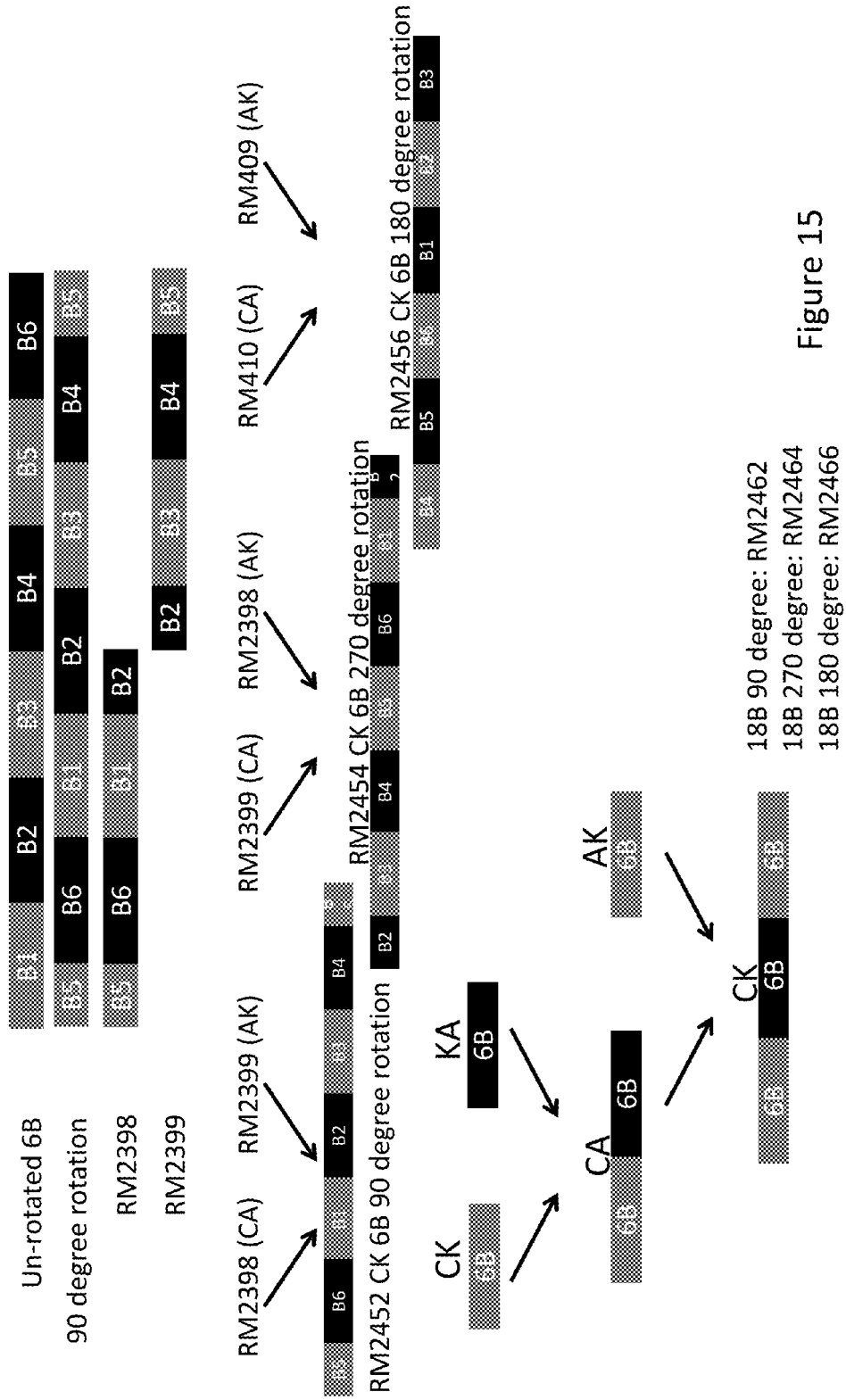
FIG. 15 illustrates the assembly of circularly permuted variants of an 18B polypeptide, according to embodiments of the invention.

The 6 repeat blocks (block co-polymer) from *Argiope bruennichi* MaSp2 identified in Example 5 were circularly permuted by approximately 90 degrees (by moving ~1.5 blocks from the end of the six blocks to the beginning), then divided into 2 R sequences consisting of ~3 blocks each, RM2398 (SEQ ID NO: 2708) and RM2399 (SEQ ID NO: 2709). These 3-block sequences were subsequently used to generate 6-block sequences rotated by ~90 and ~270 degrees from the original 6-block sequence, and existing 3-block sequences (RM409 and RM410) were used to generate a 6-block sequence rotated by ~180 degrees. Each 6-block sequence was then assembled into 18-block sequences. The assembly process and rotated sequences are depicted in FIG. 15.

Figure 16:
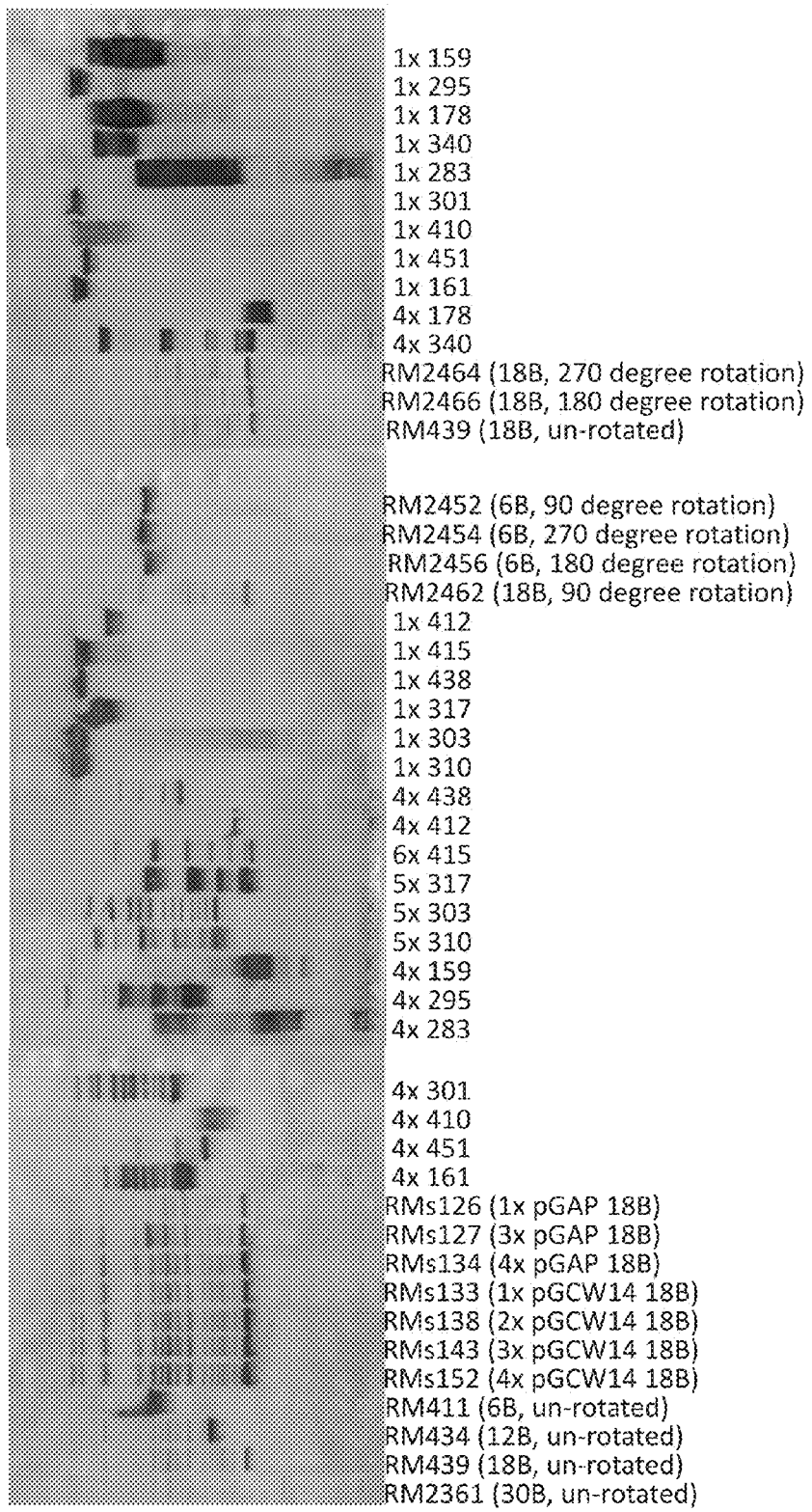
FIG. 16 shows a western blot of expressed block copolymer peptides build using silk repeat domains consisting of between 1 and 6 R domains, including circularly permuted variants and variants expressed by different promoters or different copy numbers.

To generate RM2398 and RM2399, plasmid RM439 (SEQ ID NO: 467) was amplified by PCR using either primers RM2398F (5'-CTAAGAGGTCTCACAGGTAGT-CAAGGACCTGGTTCAGG-3') (SEQ ID NO: 2834) and RM2398R (5'-TTCAGTGGTCTCTACCTTGTTGTCCTC-CAGATCCAG-3') (SEQ ID NO: 2835) or RM2399F (5'-CTAAGAGGTCTCACAGGTCCTGGAGGTCAGGGTC-CAT-3') (SEQ ID NO: 2836) and RM2399R (5'-TTCAGTGGTCTCTACCTGGTCCCTGTTGACCAG-CACCAGGA-3') (SEQ ID NO: 2837). Each reaction consisted of 12.5 μL 2×KOD Extreme Buffer, 0.25 μl KOD Extreme Hot Start Polymerase, 0.5 μl 10 μM Fwd oligo, 0.5 μl 10 μM Rev oligo, 5 ng template DNA (RM439), 0.5 μl of 10 mM dNTPs, and ddH2O added to final volume of 25 μl. Each reaction was then thermocycled according to the program:
1. Denature at 94° C. for 5 minutes
2. Denature at 94° C. for 30 seconds
3. Anneal at 55° C. for 30 seconds
4. Extend at 72° C. for 60 seconds
5. Repeat steps 2-4 for 29 additional cycles
6. Final extension at 72° C. for 5 minutes Resulting linear DNA was digested with BsaI and ligated into assembly vectors RM2086 (SEQ ID NO: 2693) and RM2089 (SEQ ID NO: 2695) that had been digested with BsmBI. Ligated material was transformed into *E. coli* for clonal isolation, DNA amplification, and sequence verification using standard methods. Using the 2ab assembly process described in Example 5 (with minor modifications to the assembly vectors to shift the BtgZI cut sites further away from the silk sequences), the 3-block fragments were assembled into two different 6-block fragments, one with RM2398 proceeding RM2399 (producing RM2452-SEQ ID NO: 2710), and one with RM2399 proceeding RM2398 (producing RM2454-SEQ ID NO: 2712). Additionally, RM409 (SEQ ID NO 463) and RM410 (SEQ ID NO 464) were digested out of the assembly vector RM396 with BbsI and BsaI, and ligated into vector RM2105 (SEQ ID NO: 2691) that had been digested with BbsI and BsaI and treated with Calf Intestinal Alkaline Phosphatase. Ligated material was transformed into *E. coli* for clonal isolation, DNA amplification, and sequence verification using standard methods. The resulting plasmids were subsequently digested with AscI and SbfI and the fragments encoding a silk isolated by gel electrophoresis, fragment excision, and gel extraction. The fragments were subsequently ligated into assembly vectors RM2086 and RM2089 that had been digested with AscI and SbfI. Ligated material was transformed into *E. coli* for clonal isolation, DNA amplification, and sequence verification using standard methods. Using 2ab assembly, a 6-block fragment consisting of RM410 proceeding RM409 was generated (producing RM2456-SEQ ID NO: 2711). RM2452, RM2454, and RM2456 were digested from assembly vector RM2081 (SEQ ID NO: 2692) with AscI and SbfI, and ligated into assembly vectors RM2088 and RM2089 that had been digested with AscI and SbfI. Ligated material was transformed into E. coli for clonal isolation, DNA amplification, and sequence verification using standard methods. Using 2ab assembly, 18-block sequences were generated from each of the three 6-block fragments, resulting in sequences RM2462 (SEQ ID NO: 2713), RM2464 (SEQ ID NO: 2715), and RM2466 (SEQ ID NO: 2714). Each of the 6-block and 18-block sequences was then digested from the assembly vector using BsaI and BbsI, and the fragments encoding a silk isolated by gel electrophoresis, fragment excision, and gel extraction. The fragments were subsequently ligated expression vector RM1007 (SEQ ID NO: 2707) that had been digested with BsmBI and treated with Calf Intestinal Alkaline Phosphatase. Ligated material was transformed into E. coli for clonal isolation, DNA amplification, and sequence verification using standard methods. Resulting plasmids were linearized with BsaI and used to transform Pichia (Komagataella) pastoris (strain RMs71, described in Example 3) using the PEG method (Cregg, J. M. et al., DNA-mediated transformation, Methods Mol. Biol., 389, pg. 27-42 (2007)). Transformants were plated on Yeast Extract Peptone Dextrose Medium (YPD) agar plates containing 25 μg/ml nourseothricin and incubated for 48 hours at 30° C. Two clones from each transformation were inoculated into 400 μl of Buffered Glycerol-complex Medium (BMGY) in a 96-well square-well block, and incubated for 48 hours at 30° C. with agitation at 1000 rpm. Cells were pelleted via centrifugation, and the supernatant was recovered for analysis of silk polypeptide content via western blot analysis of the 3× FLAG epitope. Western blot data for a representative clone of each polypeptide is shown in FIG. 16. Expression and secretion of each of the circularly permuted polypeptides appears comparable to its un-rotated counterpart. This suggests that any number of starting positions can be selected for identifying blocks in repeated silk or silk-like polypeptides without consequence on the expression or secretion of polypeptides composed of those blocks.

Example 11

Changing Expression of an Argiope bruennichi MaSp2 Polynucleotide Through Control of Copy Number and Promoter Strength The degree of transcription of an exogenously introduced polynucleotide is known to affect the amount of polypeptide produced (see e.g. Liu, H., et al., Direct evaluation of the effect of gene dosage on secretion of protein from yeast Pichia pastoris by expressing EGFP, J. Microbiol. Biotechnol., 24:2, pg. 144-151 (2014); and Hohenblum, H., et al., Effects of gene dosage, promoters, and substrates on unfolded protein stress of recombinant Pichia pastoris, Biotechnol. Bioeng., 85:4, pg. 367-375 (2004)). In Pichia (Komagataella) pastoris, the degree of transcription is commonly controlled either by increasing the number of copies of a polynucleotide that are integrated into the host genome or by selecting an appropriate promoter to drive transcription (see e.g. Hartner, F. S., et al., Promoter library designed for fine-tuned gene expression in Pichia pastoris, Nucleic Acids Res., 36:12 (2008); Zhang, A. L., et al., Recent advances on the GAP promoter derived expression system of Pichia pastoris, Mol. Biol. Rep., 36:6, pg. 1611-1619 (2009); Ruth, C., et al., Variable production windows for porcine trypsinogen employing synthetic inducible promoter variants in Pichia pastoris, Syst. Synth. Biol., 4:3, pg. 181-191 (2010); Stadlmayr, G., et al., Identification and characterisation of novel Pichia pastoris promoters for heterologous protein production, J. Biotechnol., 150:4, pg. 519-529 (2010)). A relatively recent addition to the set of promoters used for heterologous protein expression is pGCW14 (Liang, S., Identification and characterization of P GCW14: a novel, strong constitutive promoter of Pichia pastoris, Biotechnol. Lett. 35:11, pg. 1865-1871 (2013)), which is reported to be 5-10 times stronger than pGAP. To validate that the expression and secretion of silk and silk-like polypeptides can also be influenced by copy number, strains containing 1, 3, or 4 copies of pGAP driving expression of 18B (described in Example 5) and strains containing 1, 2, 3, or 4 copies of pGCW14 driving expression of 18B were generated and tested. The strains are described in Table 8.

TABLE 8

Strains with multiple polynucleotide sequences or different promoters

| Strain ID | Description | Derived From | Newly incorporated sequence(s) | Selection |
|---|---|---|---|---|
| RMs126 | 1x pGAP 18B | GS115 (NRRL Y15851) | RM439 in RM630 | Minimal Dextrose |
| RMs127 | 3x pGAP 18B | RMs126 | RM439 in RM632 and RM633 | nourseothricin, hygromycin B |
| RMs134 | 4x pGAP 18B | RMs127 | RM439 in RM631 | G418 |
| RMs133 | 1x pGCW14 18B | GS115 (NRRL Y15851) | RM439 in RM812 | Minimal Dextrose |
| RMs138 | 2x pGCW14 18B | RMs133 | RM439 in RM814 | nourseothricin |
| RMs143 | 3x pGCW14 18B | RMs138 | RM439 in RM815 | hygromycin B |
| RMs152 | 4x pGCW14 18B | RMs143 | RM439 in RM837 | G418 |

The polynucleotide sequence encoding alpha mating factor+18B+3× FLAG tag was digested from the plasmid described in Example 5 (RM468, SEQ ID NO: 1401, with RM439, SEQ ID NO: 467 cloned in) using restriction enzyme AscI and SbfI. The fragment encoding alpha mating factor+18B+3× FLAG tag was isolated by gel electrophoresis, fragment excision, and gel extraction. The resulting linear DNA was ligated into expression vectors RM630 (SEQ ID NO: 2697), RM631 (SEQ ID NO: 2698), RM632 (SEQ ID NO: 2699), RM633 (SEQ ID NO: 2700), RM812 (SEQ ID N: 2701), RM837 (SEQ ID NO: 2702), RM814 (SEQ ID N: 2703), and RM815 (SEQ ID NO: 2704) that had been digested with AscI and SbfI. Key attributes of the expression vectors are summarized in Table 9, and sequences include SEQ ID NOs: 2691-2707. Ligated material was transformed into E. coli for clonal isolation, DNA amplification, and sequence verification using standard methods.

TABLE 9

Additional vectors

| Vector ID | SEQ ID NO: | Description |
|---|---|---|
| RM2105 | 2691 | Vector for receiving silks before transfer to some assembly vectors. p15a origin, gentamycin resistance |
| RM2081 | 2692 | CK assembly vector with revised BtgZI targeting, p15a origin |
| RM2086 | 2693 | CA assembly vector with revised BtgZI targeting, p15a origin |
| RM2088 | 2694 | KA assembly vector with revised BtgZI targeting, p15a origin |
| RM2089 | 2695 | AK assembly vector with revised BtgZI targeting, p15a origin |

TABLE 9-continued

Additional vectors

| Vector ID | SEQ ID NO: | Description |
|---|---|---|
| RM747 | 2696 | Vector for receiving silks before transfer to some assembly vectors. p15a origin, gentamycin resistance |
| RM630 | 2697 | Expression vector. Integrates into HIS4 locus. pGAP promoter. |
| RM631 | 2698 | Expression vector. Integrates into AOX2 locus. pGAP promoter. Confers G418 resistance |
| RM632 | 2699 | Expression vector. Integrates into HSP82 locus. pGAP promoter. Confers nourseothricin resistance |
| RM633 | 2700 | Expression vector. Integrates into TEF1 locus. pGAP promoter. Confers hygromycin B resistance |
| RM812 | 2701 | Expression vector. Integrates into HIS4 locus. pGCW14 promoter. |
| RM837 | 2702 | Expression vector. Integrates into AOX2 locus. pGCW14 promoter. Confers G418 resistance |
| RM814 | 2703 | Expression vector. Integrates into HSP82 locus. pGCW14 promoter. Confers nourseothricin resistance |
| RM815 | 2704 | Expression vector. Integrates into TEF1 locus. pGCW14 promoter. Confers hygromycin B resistance |
| RM785 | 2705 | Expression vector. Integrates into pGAP locus. pGAP promoter. Confers nourseothricin resistance |
| RM793 | 2706 | Expression vector. Integrates into HSP82 locus. pGAP promoter. Confers nourseothricin resistance |
| RM1007 | 2707 | Expression vector. Integrates into pGAP locus. pGAP promoter. Confers nourseothricin resistance |

The polynucleotide encoding 18B in expression vector RM630 was linearized with BsaI and transformed into *Pichia (Komagataella) pastoris* (strain GS115-NRRL Y15851) using the PEG method (Cregg, J. M. et al., DNA-mediated transformation, *Methods Mol. Biol.*, 389, pg. 27-42 (2007)). Transformants were plated on Minimal Dextrose (MD) agar plates (no added amino acids) and incubated for 48 hours at 30° C. This resulted in creation of strain RMs126, 1xpGAP 18B.

RMs126 was subsequently co-transformed with the polynucleotide encoding 18B in expression vectors RM632 and RM633 (linearized with BsaI) using the electroporation method (Wu., S., and Letchworth, G. J., High efficiency transformation by electroporation of *Pichia pastoris* pretreated with lithium acetate and dithiothreitol, *Biotechniques*, 36:1, pg. 152-154 (2004)). Transformants were plated on Yeast Extract Peptone Dextrose Medium (YPD) agar plates containing 25 µg/ml nourseothricin and 100 ug/ml hygromycin B and incubated for 48 hours at 30° C. This resulted in creation of strain RMs127, 3xpGAP 18B.

RMs127 was subsequently transformed with the polynucleotide encoding 18B in expression vector RM631 (linearized with BsaI) using the PEG method. Transformants were plated on Yeast Extract Peptone Dextrose Medium (YPD) agar plates containing 300 µg/ml G418 and incubated for 48 hours at 30° C. This resulted in creation of strain RMs134, 4xpGAP 18B.

To generate strains RMs133, RMs138, RMs143, and RMs152 (1x, 2x, 3x, and 4x p754 18B, respectively), strain GS115 (NRRL Y15851) was serially transformed with the polynucleotide encoding 18B in expression vectors RM812, RM814, RM815, and RM837 (after linearizing with BsaI) using the PEG method.

A clone of each strain was inoculated into 400 µl of Buffered Glycerol-complex Medium (BMGY) in a 96-well square-well block, and incubated for 48 hours at 30° C. with agitation at 1000 rpm. Cells were pelleted via centrifugation, and the supernatant was recovered for analysis of block copolymer polypeptide content via western blot analysis of the 3x FLAG epitope. Western blot data for a representative clone of each polypeptide is shown in FIG. 16. Increasing band intensities suggest that higher transcription resulted in the expression and secretion of additional block copolymer polypeptide, confirming that the strategy of increasing transcription functions on block copolymer based on silk and silk-like polypeptide repeat units.

Example 12

Comparing Expression and Secretion of Single R Domains to Homopolymers of R Domains Additional selected R domains from SEQ ID NOs: 1-1398 that expressed and secreted well were concatenated into 4 to 6x repeat domains using the 2ab assembly (described in Example 5). Additionally, 2ab assembly was used to concatenate a 12B sequence with an 18B sequence (from Example 5), resulting in a 30B sequence. The resulting products were transferred into an expression vector, such that each silk sequence is flanked by alpha mating domain on the 5' end and a 3x FLAG domain on the 3' end and driven by a pGAP promoter. The sequences generated are described in Table 10, and the sequences include SEQ ID NOs: 2734-2748.

TABLE 10

Additional full-length block copolymer constructs with alpha mating factor, multiple repeat domains, and 3X FLAG domains

| Construct ID | DNA (with alpha mating factor and 3x FLAG) SEQ ID NO: | Amino acid (with alpha mating factor and 3x FLAG) SEQ ID NO: | Predicted Molecular Weight of Secreted Product (kDa) | Expression Vector |
|---|---|---|---|---|
| 4x 438 | 2724 | 2734 | 63.4 | RM652 |
| 4x 412 | 2725 | 2735 | 77.1 | RM1007 |
| 6x 415 | 2726 | 2736 | 75.9 | RM1007 |
| 5x 317 | 2727 | 2737 | 70.1 | RM1007 |
| 5x 303 | 2728 | 2738 | 62.0 | RM1007 |
| 5x 310 | 2729 | 2739 | 62.7 | RM1007 |
| 4x 301 | 2730 | 2740 | 47.3 | RM793 |
| 4x 410 | 2731 | 2741 | 52.3 | RM793 |
| 4x 451 | 2732 | 2742 | 57.7 | RM793 |
| 4x 161 | 2733 | 2743 | 44.9 | RM785 |
| RM2361 (30B) | 2744 | 2745 | 135.1 | RM1007 |
| RM411 (6B) | 2746 | 2749 | 29.5 | RM1007 |
| RM434 (12B) | 2747 | 2750 | 55.9 | RM1007 |
| RM439 (18B) | 2748 | 2751 | 82.31 | RM1007 |

The block copolymer expression vectors were then transformed into *Pichia (Komagataella) pastoris* (strain RMs71, described in Example 3) using the PEG method (Cregg, J. M. et al., DNA-mediated transformation, *Methods Mol. Biol.*, 389, pg. 27-42 (2007)). Transformants were plated on YPD agar plates containing 25 µg/ml nourseothricin and incubated for 48 hours at 30° C. Three clones from each transformation were picked into 400 µl of BMGY in a 96-well square-well block, and incubated for 48 hours at 30° C. with agitation at 1000 rpm. Cells were pelleted via centrifugation, and the supernatant was recovered for analysis of silk polypeptide content via western blot. A representative clone for each block copolymer construct, as well as the 1xR domain counterpart and 4xR domain constructs from Example 6, are show in FIG. 16. As observed in Example 6, streakiness and multiple bands are evident on the western blot. While the specific source of these variations has not been identified, they are generally consistent with typically observed phenomena, including polypeptide degradation and post-translational modification (e.g. glycosylation). Further, the band intensity of 4-6×R domain polypeptides appears to be weaker than the corresponding 1×R domain constructs. This is also evident in the 6B, 12B, 18B, and 30B series of *Argiope bruennichi* MaSp2 polypeptides. This suggests that longer block copolymers comprising silk repeat sequences are generally less well expressed and secreted than shorter block copolymer sequences comprising the same or different repeat sequences.

Example 13

Measuring Productivity of Strains Expressing and Secreting Silks

Table 11 lists the volumetric and specific productivities of strains expressing the polypeptides described in Example 10, Example 11, and Example 12.

TABLE 11

Productivity of strains producing silk polypeptides

| Construct ID | Volumetric productivity (mg silk/liter/hour) | Volumetric productivity error (SD, n = 3) | Specific productivity (mg silk/g DCW/hour) | Specific productivity error (SD, n = 3) |
|---|---|---|---|---|
| 1x 159 | 5.82 | 0.29 | 1.70 | 0.18 |
| 1x 295 | 5.47 | 0.27 | 1.64 | 0.17 |
| 1x 179 | 3.90 | 0.92 | 1.16 | 0.33 |
| 1x 340 | 4.94 | 0.05 | 1.45 | 0.10 |
| 1x 283 | 7.57 | 0.48 | 2.28 | 0.26 |
| 1x 301 | 3.75 | 0.27 | 1.11 | 0.14 |
| 1x 410 | 4.31 | 0.28 | 1.34 | 0.03 |
| 1x 451 | 6.69 | 0.36 | 2.16 | 0.11 |
| 1x 161 | 4.55 | 0.09 | 1.45 | 0.22 |
| 4x 478 | 1.08 | 0.17 | 0.34 | 0.09 |
| 4x 340 | 4.91 | 0.59 | 1.58 | 0.41 |
| RM2464 (18B, 270 degree rotation) | 19.13 | 0.14 | 5.25 | 0.64 |
| RM2466 (18B, 180 degree rotation) | 15.70 | 0.60 | 4.48 | 0.61 |
| RM439 (18B, unrotated) | 19.22 | 0.84 | 5.53 | 0.68 |
| RM2452 (6B, 90 degree rotation) | 9.28 | 0.07 | 2.63 | 0.15 |
| RM2454 (6B, 180 degree rotation) | 10.76 | 0.40 | 3.18 | 0.22 |
| RM2456 (6B, 180 degree rotation) | 10.21 | 0.23 | 2.99 | 0.22 |
| RM2462 (18B, 90 degree rotation) | 15.25 | 0.56 | 4.69 | 0.33 |
| 1x 412 | 2.95 | 0.53 | 0.96 | 0.22 |
| 1x 415 | 7.67 | 0.69 | 2.18 | 0.04 |
| 1x 438 | 5.69 | 0.57 | 1.59 | 0.26 |
| 1x 317 | 4.61 | 0.09 | 1.25 | 0.13 |
| 1x 303 | 5.41 | 0.11 | 1.52 | 0.15 |
| 1x 310 | 6.65 | 0.06 | 1.93 | 0.19 |
| 4x 438 | 1.68 | 0.24 | 0.50 | 0.03 |
| 4x 412 | 1.29 | 0.14 | 0.35 | 0.01 |
| 6x 415 | 0.50 | 0.15 | 0.14 | 0.03 |
| 5x 317 | 5.15 | 0.28 | 1.43 | 0.07 |
| 5x 303 | 0.63 | 0.07 | 0.19 | 0.03 |
| 5x 310 | 0.52 | 0.07 | 0.15 | 0.03 |
| 4x 159 | 24.81 | 2.38 | 7.72 | 0.82 |
| 4x 295 | 4.92 | 0.56 | 1.60 | 0.26 |
| 4x 283 | 18.70 | 0.58 | 5.87 | 0.57 |
| 4x 301 | 0.45 | 0.06 | 0.14 | 0.01 |
| 4x 410 | 1.49 | 0.05 | 0.47 | 0.05 |
| 4x 451 | 2.13 | 0.12 | 0.68 | 0.05 |
| 4x 161 | 1.80 | 0.14 | 0.57 | 0.03 |
| RMs126 (1x pGAP 18B) | 14.21 | 1.11 | 4.56 | 0.63 |
| RMs127 (3x pGAP 18B) | 28.61 | 2.05 | 8.81 | 0.80 |
| RMs134 (4x pGAP 18B) | 30.89 | 1.48 | 9.73 | 0.83 |
| RMs133 (1x pGCW14 18B) | 36.90 | 2.43 | 12.14 | 1.39 |
| RMs138 (2x pGCW14 18B) | 47.31 | 3.66 | 16.42 | 1.45 |
| RMs143 (3x pGCW14 18B) | 56.49 | 0.97 | 20.96 | 0.72 |
| RMs152 (4x pGCW14 18B) | 58.06 | 4.31 | 20.97 | 3.74 |
| RM411 (6B, un-rotated) | 12.01 | 1.16 | 3.76 | 0.31 |
| RM434 (12B, un-rotated) | 17.57 | 1.47 | 5.50 | 0.22 |
| RM439 (18B, un-rotated) | 14.36 | 1.25 | 4.56 | 0.21 |
| RM2361 (30B, un-rotated) | 8.81 | 0.58 | 2.87 | 0.39 |

To measure productivity, 3 clones of each strain were inoculated into 400 μl of Buffered Glycerol-complex Medium (BMGY) in a 96-well square-well block, and incubated for 48 hours at 30° C. with agitation at 1000 rpm. Following the 48-hour incubation, 4 μl of each culture was used to inoculate a fresh 400 μl of BMGY in a 96-well square-well block, which was then incubated for 24 hours 30° C. with agitation at 1000 rpm. Cells were then pelleted by centrifugation, the supernatant removed, and the cells resuspended in 400 μl of fresh BMGY. The cells were again pelleted by centrifugation, the supernatant removed, and the cells resuspended in 800 μl of fresh BMGY. From that 800 μl, 400 μl was aliquoted into a 96-well square-well block, which was then incubated for 2 hours at 30° C. with agitation at 1000 rpm. After the 2 hours, the OD600 of the cultures was recorded, and the cells were pelleted by centrifugation and the supernatant collected for further analysis. The concentration of block copolymer polypeptide in each supernatant was determined by direct enzyme-linked immunosorbent assay (ELISA) analysis quantifying the 3× FLAG epitope.

The relative productivities of each strain confirm qualitative observations made based on western blot data. The circularly permuted polypeptides express at similar levels to un-rotated silks, stronger promoters or more copies lead to higher block copolymer expression and secretion, and longer block copolymer polypeptides comprising silk repeat sequences generally express less well than shorter block copolymers comprising the same or different repeat sequences. Interestingly, the grams of 12B (55.9 kDa) produced exceeds the grams of 6B (29.5 kDa) produced, suggesting that the factors leading to decreased expression of larger block copolymers comprising silk repeat sequences may not become dominant until expression of block copolymers closer to the size of 18B (82.2 kDa) Importantly, most of the block copolymer polypeptides have a relatively high specific productivity (>0.1 mg silk/g Dry Cell Weight (DCW)/hour. In some embodiments, the productivity is above 2 mg silk/g DCW/hour. In further embodiments, the productivity is above 5 mg silk/g DCW/hour), before any optimization of the level of polypeptide transcription. Additional transcription improved the productivity of 18B by approximately 5-fold to 20 (almost 21) mg polypeptide/g DCW/hour.

Example 14

Measuring Mechanical Properties of Silk Fiber

The block copolymer polypeptide produced in Example 5 was spun into a fiber and tested for various mechanical properties. First, a fiber spinning solution was prepared by dissolving the purified and dried block copolymer polypeptide in a formic acid-based spinning solvent, using standard techniques. Spin dopes were incubated at 35° C. on a rotational shaker for three days with occasional mixing. After three days, the spin dopes were centrifuged at 16000 rcf for 60 minutes and allowed to equilibrate to room temperature for at least two hours prior to spinning.

Figure 17:
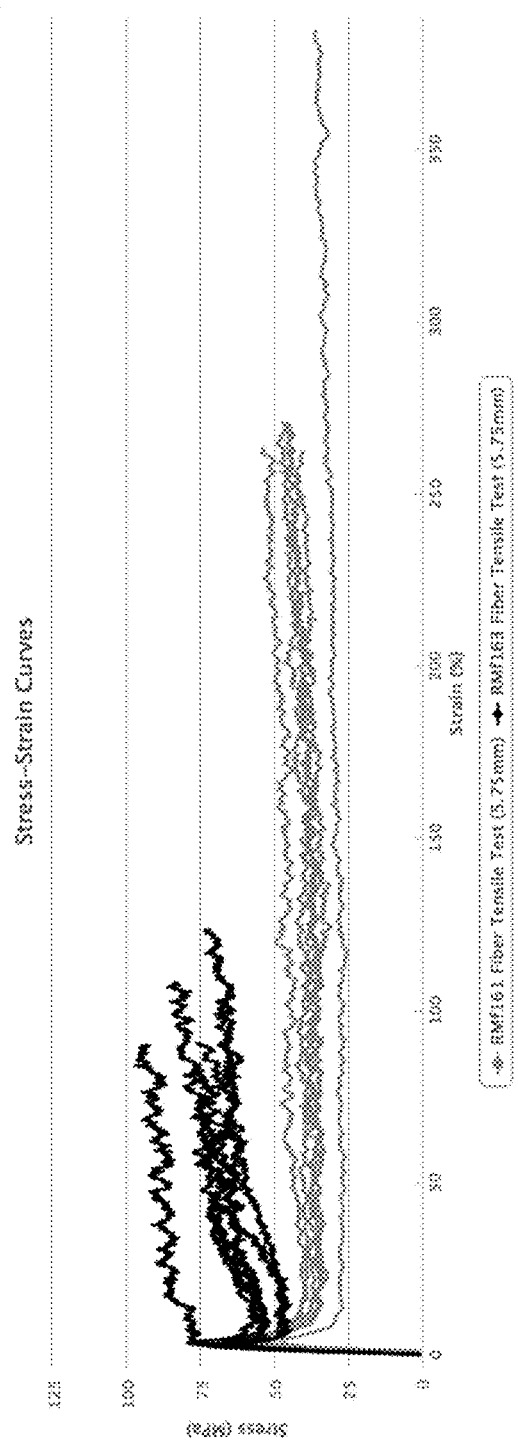
FIG. 17 are stress-strain curves showing the effect of draw ratio of block copolymer fibers of an 18B polypeptide.

The spin dope was extruded through a 50-200 μm diameter orifice into a standard alcohol-based coagulation bath. Fibers were pulled out of the coagulation bath under tension, drawn from 1 to 5 times their length, and subsequently allowed to dry. At least five fibers were randomly selected from the at least 10 meters of spun fibers. These fibers were tested for tensile mechanical properties using an instrument including a linear actuator and calibrated load cell. Fibers were pulled at 1% strain until failure. Fiber diameters were measured with light microscopy at 20× magnification using image processing software. The mean maximum stress ranged from 54-310 MPa. The mean yield stress ranged from 24-172 MPa. The mean maximum strain ranged from 2-200%. The mean initial modulus ranged from 1617-5820 MPa. The effect of the draw ratio is illustrated in Table 12 and FIG. 17. Also, the average toughness of three fibers was measured at 0.5 MJ m$^{-3}$ (standard deviation of 0.2), 20 MJ m$^{-3}$ (standard deviation of 0.9), and 59.2 MJ m$^{-3}$ (standard deviation of 8.9)

TABLE 12

Effect of draw ratio

|  | 2.5x | 5x |
|---|---|---|
| Mean Maximum Stress (MPa) | 58 | 80 |
| Mean Yield Stress (Mpa) | 53 | 61 |
| Mean max strain (%) | 277 | 94 |
| Mean initial modulus (MPa) | 1644 | 2719 |

Fiber diameters were determined as the average of at least 4-8 fibers selected randomly from at least 10 m of spun fibers. For each fiber, six measurements were made over the span of 0.57 cm. The diameters ranged from 4.48-12.7 μm. Fiber diameters were consistent within the same sample. Samples ranged over various average diameters: 10.3 μm (standard deviation of 0.4 μm), 13.47 μm (standard deviation of 0.36 μm), 12.05 μm (standard deviation of 0.67), 14.69 μm (standard deviation of 0.76 μm), and 9.85 μm (standard deviation of 0.38 μm).

Figure 18:
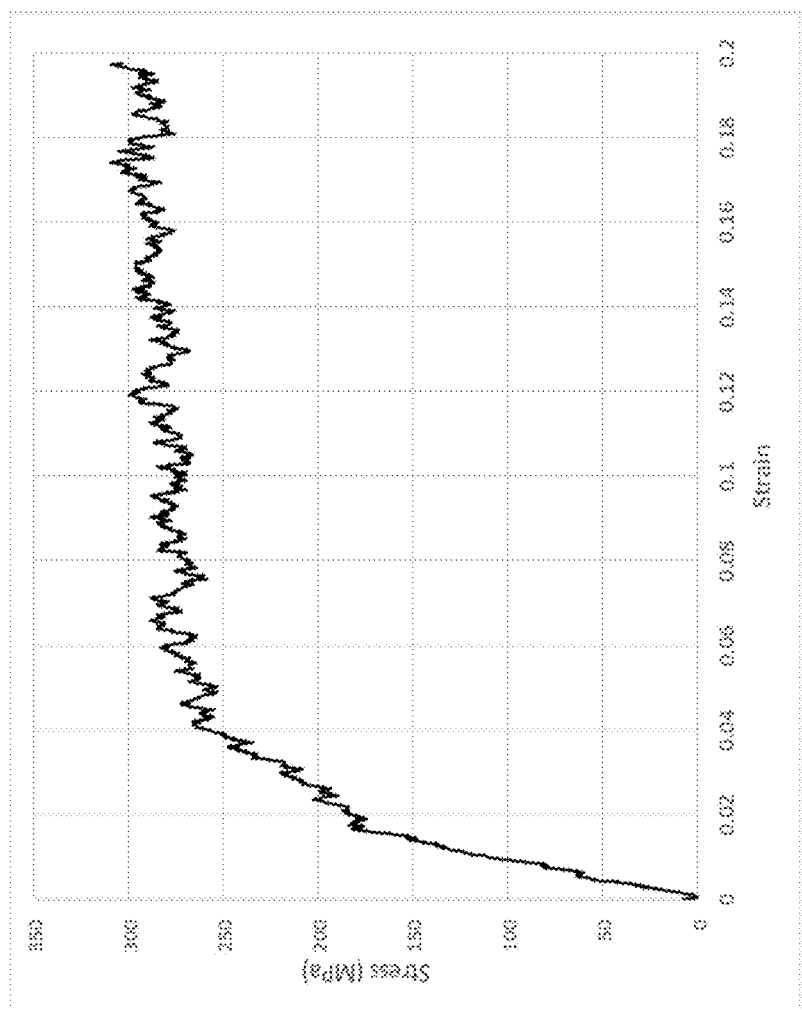
FIG. 18 is a stress-strain curve for a block copolymer fiber comprising SEQ ID NO: 1398.

One particularly effective fiber which was spun from block copolymer material that was generated from an optimized recovery and separations protocol had a maximum ultimate tensile strength of 310 MPa, a mean diameter of 4.9 μm (standard deviation of 0.8), and a max strain of 20%. Fiber tensile test results are shown in FIG. 18.

Figure 19:
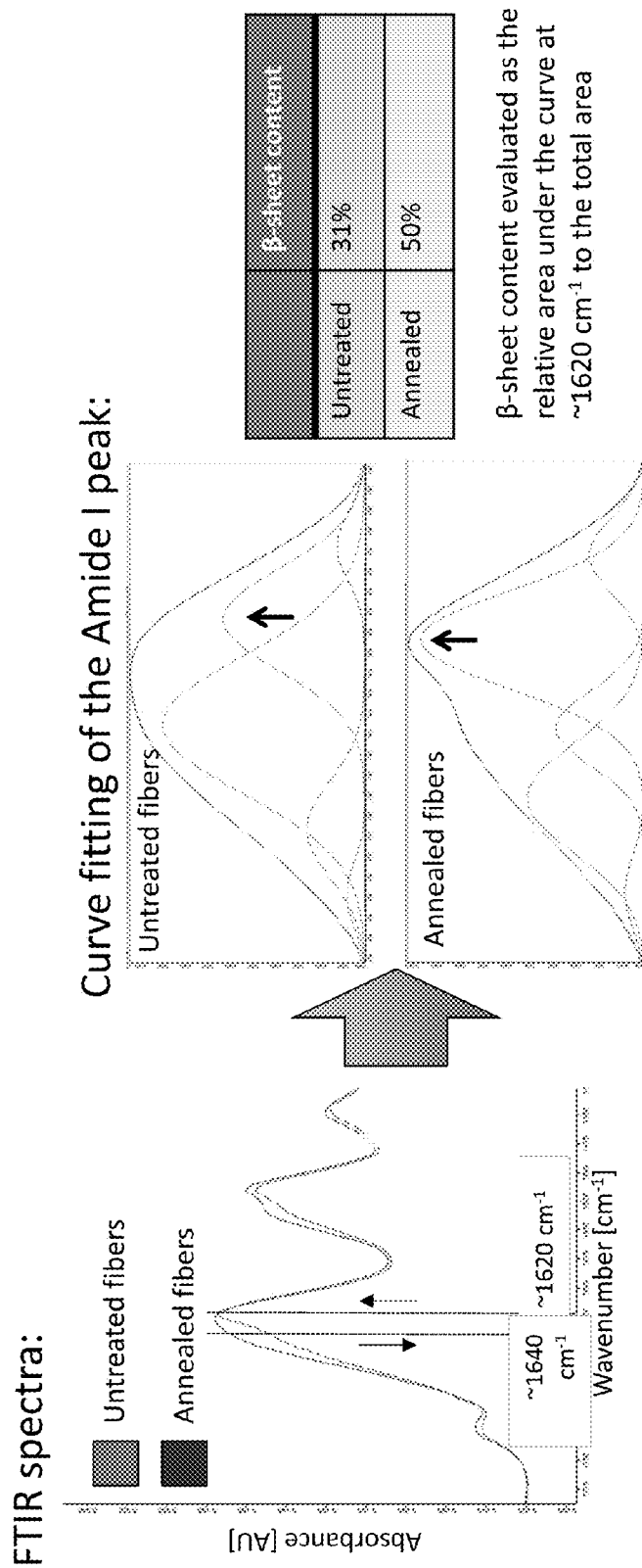
FIG. 19 shows the results of FTIR spectra for untreated and annealed block copolymer fibers.

Fibers were dried overnight at room temperature. FTIR spectra were collected with a diamond ATR module from 400 cm$^{-1}$ to 4000 cm$^{-1}$ with 4 cm$^{-1}$ resolution (FIG. 19). The amide I region (1600 cm$^{-1}$ to 1700 cm$^{-1}$) was baselined and curve fitted with Gaussian profiles at 5-6 location determined by peak locations from the second derivative of the original curve. The β-sheet content was determined as the area under the Gaussian profile at ~1620 cm$^{-1}$ and ~1690 cm$^{-1}$ divided by the total area of the amide I region. Annealed and untreated fibers were tested. For annealing, fibers were incubated within a humidified vacuum chamber at 1.5 Torr for at least six hours. Untreated fibers were found to contain 31% β-sheet content, and annealed fibers were found to contain 50% β-sheet content.

Figure 20:
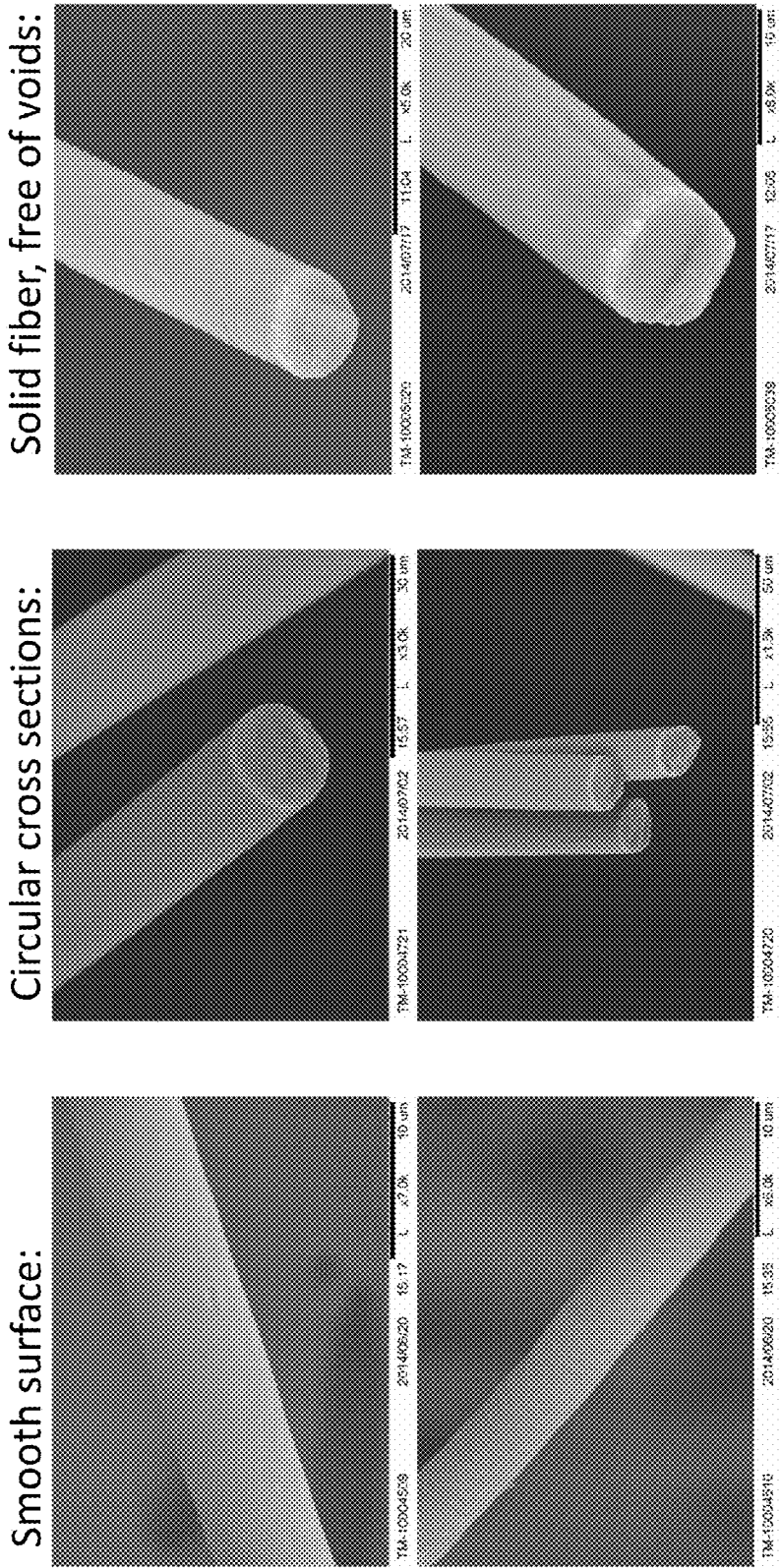
FIG. 20 shows scanning electron micrographs of block copolymer fibers of the invention.

Fiber cross-sections were examined by freeze fracture using liquid nitrogen. Samples were sputter coated with platinum/palladium and imaged with a Hitachi TM-1000 at 5 kV accelerating voltage. FIG. 20 shows that the fibers have smooth surfaces, circular cross sections, and are solid and free of voids. In some embodiments Example 15

Production of Optimal Fibers

An R domain of MaSp2-like silks is selected from those listed in Tables 13a and 13b, and the R domain is concatenated into 4× repeat domains flanked by alpha mating factor on the 5' end and 3× FLAG on the 3' end using the assembly scheme shown in FIG. 12. The concatenation is performed as described in Example 4 and shown in FIG. 7 and FIG. 8. The resulting polynucleotide sequence and corresponding polypeptide sequences are listed in Tables 13a and 13b.

Figure 21:
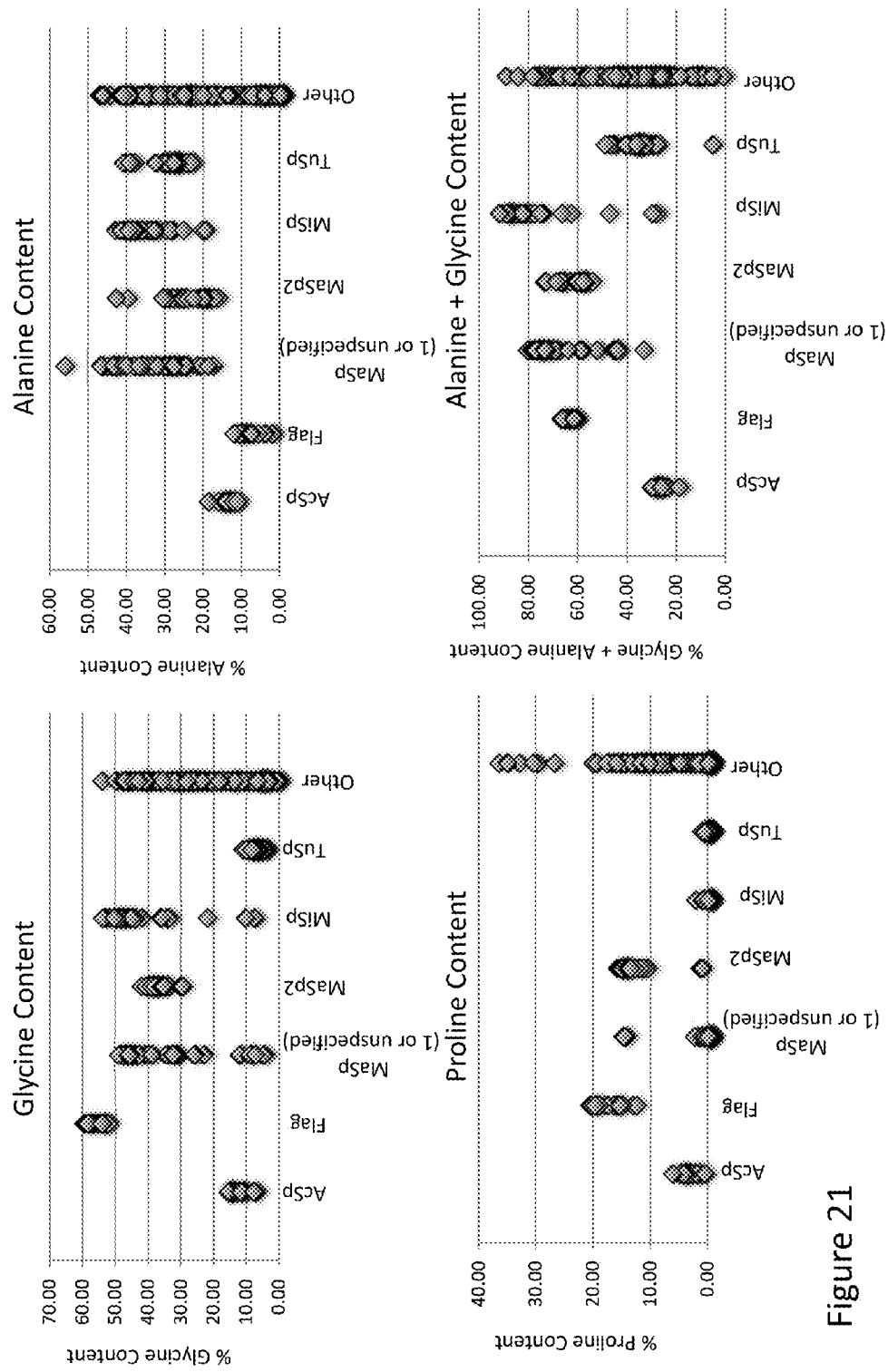
FIG. 21 illustrates graphs showing the amino acid content of various silk repeat sequences that can be expressed as block copolymers useful for the production of fibers.

Of the sequences in Tables 13a and 13b: (1) the proline content ranges from 11.35-15.74% (the percentages of Tables 13a and 13b refer to a number of amino acid residues of the specified content—in this case, proline—over a total number of amino acid residues in the corresponding polypeptide sequence). The proline content of similar R domains could also range between 13-15%, 11-16%, 9-20%, or 3-24%; (2) the alanine content ranges between 16.09-30.51%. The alanine content of similar R domains could also range between 15-20%, 16-31%, 12-40%, or 8-49%; (3) the glycine content ranges between 29.66-42.15%. The glycine content of similar R domains could also range between 38-43%, 29-43%, 25-50%, or 21-57%; (4) The glycine and alanine content ranges between 54.17-68.59%. The glycine and alanine content of similar R domains could also range between 54-69%, 48-75%, or 42-81%; (5) the β-turn content ranges between 18.22-32.16%. β-turn content is calculated using the SOPMA method from Geourjon, C., and Deleage, G., SOPMA: significant improvements in protein secondary structure prediction by consensus prediction from multiple alignments, *Comput. Appl. Biosci.*, 11:6, pg. 681-684 (1995). The SOPMA method is applied using the following parameters: window width—10; similarity threshold—10; number of states—4. The β-turn content of similar R domains could also range between 25-30%, 18-33%, 15-37%, or 12-41%; (6) the poly-alanine content ranges between 12.64-28.85%. A motif is considered a poly-alanine motif if it includes at least four consecutive alanine residues. The poly-alanine content of similar R domains could also range between 12-29%, 9-35%, or 6-41%; (7) the GPG motif content ranges between 22.95-46.67%. The GPG motif content of similar R domains could also range between 30-45%, 22-47%, 18-55%, or 14-63%; (8) the GPG and poly-alanine content ranges between 42.21-73.33%. The GPG and poly-alanine content of similar R domains could also range between 25-50%, 20-60%, or 15-70%. Other silk types exhibit different ranges of amino acid content and other properties. FIG. 21 shows ranges of glycine, alanine, and proline content for various silk types of the silk polypeptide sequences disclosed herein. FIG. 21 illustrates percentages of glycine, alanine, or proline amino acid residues over a total number of residues in the polypeptide sequences.

The resulting product of the concatenation comprising 4 repeat sequences, an alpha mating factor, and a 3× FLAG domain is digested with AscI and SbfI to release the desired silk sequence and ligated into expression vectors RM812 (SEQ ID N: 2701), RM837 (SEQ ID NO: 2702), RM814 (SEQ ID NO: 2703), and RM815 (SEQ ID NO: 2704) (key attributes of the expression vectors are summarized in Table 9) that have been digested with AscI and SbfI. A strain containing 4 copies of the silk polynucleotide under the transcriptional control of pGCW14 is generated by serially transforming *Pichia* (*Komagataella*) *pastoris* strain GS115 (NRRL Y15851) with the resulting expression vectors (after linearizing them with BsaI) using the PEG method. Similar quasi-repeat domains can range between 500-5000, 119-1575, 300-1200, 500-1000, or 900-950 amino acids in length. The entire block co-polymer can range between 40-400, 12.2-132, 50-200, or 70-100 kDa.

TABLE 13a

Properties of selected R domains

| 1x Repeat Domain Amino Acid SEQ ID NO | 1x Repeat Domain DNA SEQ ID NO | Alpha Mating Factor + 4x Repeat Domain + 3xFLAG Amino Acid SEQ ID NO | Alpha Mating Factor + 4x Repeat Domain + 3xFLAG DNA SEQ ID NO | % Proline | % Alanine | % Glycine | % Glycine + Alanine |
|---|---|---|---|---|---|---|---|
| 1313 | 382 | 2752 | 2777 | 14.22 | 21.10 | 38.07 | 59.17 |
| 1314 | 383 | 2753 | 2778 | 14.75 | 20.86 | 37.77 | 58.63 |
| 1315 | 384 | 2754 | 2779 | 14.74 | 18.33 | 39.84 | 58.17 |
| 1316 | 385 | 2755 | 2780 | 14.91 | 18.42 | 39.91 | 58.33 |
| 1317 | 386 | 2756 | 2781 | 14.79 | 18.68 | 39.69 | 58.37 |
| 1318 | 387 | 2757 | 2782 | 14.12 | 19.22 | 40.78 | 60.00 |
| 1319 | 388 | 2758 | 2783 | 14.68 | 18.65 | 39.68 | 58.33 |
| 1320 | 389 | 2759 | 2784 | 14.56 | 16.09 | 42.15 | 58.24 |
| 1321 | 390 | 2760 | 2785 | 14.73 | 18.99 | 39.53 | 58.53 |
| 1328 | 397 | 2761 | 2786 | 15.00 | 20.71 | 38.57 | 59.29 |
| 1329 | 398 | 2762 | 2787 | 14.29 | 20.71 | 38.57 | 59.29 |
| 1331 | 400 | 2763 | 2788 | 14.39 | 20.14 | 38.13 | 58.27 |
| 1335 | 404 | 2764 | 2789 | 11.86 | 30.51 | 29.66 | 60.17 |
| 1336 | 405 | 2765 | 2790 | 12.72 | 24.12 | 35.96 | 60.09 |
| 1337 | 406 | 2766 | 2791 | 13.52 | 22.54 | 35.25 | 57.79 |
| 1340 | 409 | 2767 | 2792 | 11.35 | 20.09 | 37.99 | 58.08 |
| 1370 | 439 | 2768 | 2793 | 15.74 | 17.13 | 37.04 | 54.17 |
| 1373 | 442 | 2769 | 2794 | 15.56 | 26.67 | 40.00 | 66.67 |
| 1374 | 443 | 2770 | 2795 | 14.22 | 28.89 | 38.22 | 67.11 |
| 1375 | 444 | 2771 | 2796 | 14.35 | 26.85 | 39.35 | 66.20 |
| 1376 | 445 | 2772 | 2797 | 15.18 | 26.79 | 39.29 | 66.07 |
| 1378 | 447 | 2773 | 2798 | 14.44 | 27.81 | 39.04 | 66.84 |
| 1379 | 448 | 2774 | 2799 | 14.94 | 25.86 | 40.80 | 66.67 |
| 1380 | 449 | 2775 | 2800 | 14.10 | 29.49 | 39.10 | 68.59 |
| 1384 | 453 | 2776 | 2801 | 12.16 | 25.00 | 35.81 | 60.81 |

TABLE 13b

Properties of selected R domains

| 1x Repeat Domain Amino Acid SEQ ID NO | 1x Repeat Domain DNA SEQ ID NO | Alpha Mating Factor + 4x Repeat Domain + 3xFLAG Amino Acid SEQ ID NO | Alpha Mating Factor + 4x Repeat Domain + 3xFLAG DNA SEQ ID NO | % Beta Turn | % Poly alanine | % GPG motif | % GPG + Poly Alanine | MW |
|---|---|---|---|---|---|---|---|---|
| 1313 | 382 | 2752 | 2777 | 28.44 | 17.89 | 27.52 | 45.41 | 76044 |
| 1314 | 383 | 2753 | 2778 | 30.22 | 17.63 | 28.06 | 45.68 | 95860 |
| 1315 | 384 | 2754 | 2779 | 30.68 | 15.54 | 32.27 | 47.81 | 86818 |
| 1316 | 385 | 2755 | 2780 | 28.51 | 14.91 | 31.58 | 46.49 | 79731 |
| 1317 | 386 | 2756 | 2781 | 28.79 | 15.56 | 32.68 | 48.25 | 89297 |
| 1318 | 387 | 2757 | 2782 | 32.16 | 16.08 | 30.59 | 46.67 | 88136 |
| 1319 | 388 | 2758 | 2783 | 30.56 | 15.87 | 32.14 | 48.02 | 87103 |
| 1320 | 389 | 2759 | 2784 | 28.74 | 12.64 | 31.03 | 43.68 | 90778 |
| 1321 | 390 | 2760 | 2785 | 28.68 | 15.89 | 32.56 | 48.45 | 89582 |
| 1328 | 397 | 2761 | 2786 | 31.43 | 17.86 | 32.14 | 50.00 | 49712 |
| 1329 | 398 | 2762 | 2787 | 29.29 | 17.86 | 30.00 | 47.86 | 49836 |
| 1331 | 400 | 2763 | 2788 | 29.50 | 17.27 | 30.22 | 47.48 | 49672 |

TABLE 13b-continued

Properties of selected R domains

| 1x Repeat Domain Amino Acid SEQ ID NO | 1x Repeat Domain DNA SEQ ID NO | Alpha Mating Factor + 4x Repeat Domain + 3xFLAG Amino Acid SEQ ID NO | Alpha Mating Factor + 4x Repeat Domain + 3xFLAG DNA SEQ ID NO | % Beta Turn | % Poly alanine | % GPG motif | % GPG + Poly Alanine | MW |
|---|---|---|---|---|---|---|---|---|
| 1335 | 404 | 2764 | 2789 | 18.22 | 24.58 | 25.42 | 50.00 | 83965 |
| 1336 | 405 | 2765 | 2790 | 25.00 | 19.74 | 30.26 | 50.00 | 80845 |
| 1337 | 406 | 2766 | 2791 | 22.54 | 18.85 | 22.95 | 42.21 | 87160 |
| 1340 | 409 | 2767 | 2792 | 20.09 | 16.59 | 27.51 | 44.10 | 81149 |
| 1370 | 439 | 2768 | 2793 | 26.85 | 15.28 | 40.28 | 55.56 | 77581 |
| 1373 | 442 | 2769 | 2794 | 25.78 | 26.67 | 46.67 | 73.33 | 76502 |
| 1374 | 443 | 2770 | 2795 | 26.67 | 28.00 | 42.67 | 70.67 | 75716 |
| 1375 | 444 | 2771 | 2796 | 24.07 | 26.39 | 43.06 | 69.44 | 73742 |
| 1376 | 445 | 2772 | 2797 | 28.12 | 26.34 | 44.20 | 70.54 | 76433 |
| 1378 | 447 | 2773 | 2798 | 24.60 | 27.27 | 43.32 | 70.59 | 63684 |
| 1379 | 448 | 2774 | 2799 | 25.86 | 25.86 | 44.83 | 70.69 | 59391 |
| 1380 | 449 | 2775 | 2800 | 27.56 | 28.85 | 42.31 | 71.15 | 53049 |
| 1384 | 453 | 2776 | 2801 | 28.38 | 18.24 | 24.32 | 42.57 | 52668 |

A clone of the resulting strain is cultured according to the following conditions: the culture is grown in a minimal basal salt media, similar to one described in [http://tools.invitrogen.com/content/sfs/manuals/pichiaferm_prot.pdf] with 50 g/L of glycerol as a starting feedstock. Growth occurs in a stirred fermentation vessel controlled at 30 C, with 1 VVM of air flow and 2000 rpm agitation. pH is controlled at 3 with the on-demand addition of ammonium hydroxide. Additional glycerol is added as needed based on sudden increases in dissolved oxygen. Growth is allowed to continue until dissolved oxygen reached 15% of maximum at which time the culture is harvested, typically at 200-300 OD of cell density.

The broth from the fermenter is decellularized by centrifugation. The supernatant from the Pichia (Komagataella) pastoris culture is collected. Low molecular weight components are removed from the supernatant using ultrafiltration to remove particles smaller than the block copolymer polypeptides. The filtered culture supernatant is then concentrated up to 50x.

The fiber spinning solution is prepared by dissolving the purified and dried block copolymer polypeptide in a formic acid-based spinning solvent. Spin dopes are incubated at 35° C. on a rotational shaker for three days with occasional mixing. After three days, the spin dopes are centrifuged at 16000 rcf for 60 minutes and allowed to equilibrate to room temperature for at least two hours prior to spinning. The spin dope is extruded through a 150 μm diameter orifice into a standard alcohol-based coagulation bath. Fibers are pulled out of the coagulation bath under tension, drawn from 1 to 5 times their length, and subsequently allowed to dry as a tight hank.

At least five fibers are randomly selected from at least 10 meters of spun fibers. Fibers are tested for tensile mechanical properties using a custom instrument, which includes a linear actuator and calibrated load cell. Fibers are mounted with a gauge length of 5.75 mm and pulled at a 1% strain rate until failure. The ultimate tensile strengths of the fibers are measured to be between 50-500 MPa. Depending on which fibers are selected: the yield stress is measured to be 24-172 MPa or 150-172 MPa, the ultimate tensile strength (maximum stress) is measured to be 54-310 MPa or 150-310 MPa, the breaking strain is measured to be 2-200% or 180-200%, the initial modulus is measured to be 1617-5820 MPa or 5500-5820 MPa, and the toughness value is measured to be at least 0.5 MJ/m$^3$, at least 3.1 MJ/m$^3$, or at least 59.2 MJ/m$^3$.

The resultant forces are normalized to the fiber diameter, as measured by light microscopy. Fiber diameters are measured with light microscopy at 20× magnification using image processing software. Fiber diameters are determined as the average of at least 4-8 fibers selected randomly from at least 10 m of spun fibers. For each fiber, six measurements are made over the span of 5.75 mm Depending on which fibers are selected, the fiber diameters are measured to be between 4-100 μm, between 4.48-12.7 μm, or between 4-5 μm.

To test the β-sheet crystallinity content of the fibers, the fibers are dried overnight at room temperature. FTIR spectra are collected with a diamond ATR module from 400 cm$^{-1}$ to 4000 cm$^{-1}$ with 4 cm$^{-1}$ resolution. The amide I region (1600 cm$^{-1}$ to 1700 cm$^{-1}$) is baselined and curve fitted with Gaussian profiles at 5-6 location determined by peak locations from the second derivative of the original curve. The β-sheet content is determined as the area under the Gaussian profile at ~1620 cm$^{-1}$ and ~1690 cm$^{-1}$ divided by the total area of the amide I region. To induce β-sheet crystallinity, fibers are incubated within a humidified vacuum chamber at 1.5 Torr for at least six hours. Fiber surface morphology and cross-sections (taken by freeze fracture using liquid nitrogen) are analyzed via scanning electron microscopy. Samples are sputter coated with platinum/palladium and imaged with a Hitachi TM-1000 at 5 kV accelerating voltage.

A number of embodiments of the invention have been described. Nevertheless, it will be understood that various modifications may be made without departing from the spirit and scope of the invention.

SEQUENCE LISTING (2843 sequences)

SEQ ID NO: 1 - DNA, 441 bp, Artificial Sequence
  Description of Artificial Sequence: Synthetic polynucleotide
ggtgcagcgtctgcatctggtgctgcgagcgcctctggtgcagcatccgcgtcagaagcagcaagttcttcctccacaaccataactactaaaggcacttctgcatcgggacttctatcttccccatatggctcggtcagtatttcggttgaaaatagaattatctctttgatatcgtcaatcttgagcgagttcatttctatcgagtccgcttttaactattcctcattcgctaaaaagctggcctttttggcatctgagatctcggtgtccaatccaggtctttctgctagtgaagtcattagtgaggtattgttggagacagtgacagctcttatccacatcttggcaagtagtcaagtgggttcagtctcaacagccgatttgagctctgtttcaagagcctttgctcagtcgttcgcccaggctttcgcacaccaa

SEQ ID NO: 2 - DNA, 540 bp, Artificial Sequence
  Description of Artificial Sequence: Synthetic polynucleotide
ggtgcagcagctacttctagtagtaccactgctgcatcttccgctggctcctcgtcgagtgtatcttcaatttcggcaggtgtgtcctctgatgccggcggcgcctatctatccggagacgtttccgaattcggatccagcggtagtttgccacaagctgtgctcccactgtctcaatggccaggtactggttcttcgggagcagatctattgatatcagatctcctcagtttgagagatggattgctatccagctctgcgtcagagagaatttctgctattattttgccattggtttctgcattatctccgactggagtaaacttctcagagataggtaatattattctttccttaataagtaagataagcggatcatgtgtcggtttatcgccgtctcagaccttttccgaggcattgctggaagttattattgctctaatgcagattttgtcctccgccaaggtcacgacagtatcaacaagtgctagcggaaccgcaagatccttggctcagagtctatcatcagctatggctgga

SEQ ID NO: 3 - DNA, 510 bp, Artificial Sequence
  Description of Artificial Sequence: Synthetic polynucleotide
ggtgctagctccacaactaccacaacggaggctacaggcagtgatgcgtcagcaagaagaatatcgtccggagcatcttccgaaactgccgcgtcatctgtggtagatagttcagtattttccggtgacgtgtcagactactctggtttcaatgtattacctttggtcagcgatctattgtccagttcttcaggattatctagtccagctgccattagacgcatcgactctcttattccattgttgttttcctcagcatcctccaataatttgagtgcatcattcctatccaacgtgttggctactagtgtttctcagatctccgaaggttcatcgggtttatcagctactcagattatcattgaggctttgttcgaactgattagcggactaatgcatattctgacctctgcccactttgacgcagtttcaagggccacatcctcggccacagcctctgcactggccaactcactgtctactgcattttcaggagttaataatatcgca

SEQ ID NO: 4 - DNA, 456 bp, Artificial Sequence
  Description of Artificial Sequence: Synthetic polynucleotide
ggtgcaggtgcaagggctgctggaggctacggtggaggatacggtgccggtgcgggtgcaggagccggcgccgcagcttccgccggagcctccggtggatacggaggtggatatggtggcggagctggtgctggtgccgtagcaggtgcctcagctggaagctacggaggtgctgttaatagactgagttccgcaggtgcagcctctagagtgtcgtccaacgtcgcagccattgcatctgctggtgctgccgctttgcccaacgttatttccaacatctatagtggtgttctttcatctggcgtgtcatcctccgaagcacttattcaggctttgttagaagtaatcagtgctttaattcatgtcttaggatcagcttctatcggcaacgtttcatctgttggtgttaattccgcacttaatgctgtgcaaaacgccgtaggcgcctatgccgga

SEQ ID NO: 5 - DNA, 435 bp, Artificial Sequence
  Description of Artificial Sequence: Synthetic polynucleotide
ggtggacagggtggtcaaggaggttacggaggactaggaccgcagggtgctggcggcgccggtcagggtggatatggcggtggctcattacagtatggcggacaaggccaagcgcaagcggcagcagcttctgccgctgctagcagattgagttccccatcagctgctgcaagagtctcctccgctgtaagcctcgtgtcaaatggaggacctactagtccagctgctctgagttcgtctatttctaatgtagtatctcaaatttccgccagtaacccgggattgagcggatgtgacatattggttcaagctctattggaaattatcagtgcacttgtgcacatactgggctcggccaatattggccctgttaattcatcctcagctggtcaatccgctagcatcgtgggccaaagtgtatacagagcactctca

SEQ ID NO: 6 - DNA, 462 bp, Artificial Sequence
  Description of Artificial Sequence: Synthetic polynucleotide
ggtggttacggaccaggatcgggtcagcaaggaccgggacaacaaggtcctggtcaacaaggcccaggaggtcaaggtccatatggacctggtgcagccagcgcagctgtttctgtcggtggctatggtccccagagctcttccgttccagttgcttccgcagtggcatctagacttagttctcctgccgcgagttctcgagtcagttctgctgtgtcatcattagtatctagcggtccaactaaacacgcagctcttagtaacaccattagctctgtggtaagccaggtatctgctagtaatcccggattatccggatgtgatgtactggtccaggcattgctggaggtggtcagtgcattggtttccatcttgggcagtagtagtatcggtcaaattaactatggtgccagcgcccagtacactcaaatggtaggacagagtgtggctcaggccctagca

SEQ ID NO: 7 - DNA, 402 bp, Artificial Sequence
  Description of Artificial Sequence: Synthetic polynucleotide
ggtagtggaccaggaggatacggccctggctcacaaggtcctagcggtcctggttaccagggtccctcaggtccaggtgcatatggaccttccccatcagcttcagcttcggttgctgcatctgtctacctgagacttcaaccacgtctggaagtatcatccgctgttagtagtctagtatcgagtggtccaacaaatggtgctgcagtaagtggagctctgaactctctagtttctcagatttccgcatcaaacccaggtttgtccggttgtgacgcgctagttcaagctctgcttgaactagtctctgctttggttgcaattctctcttccgcgtcaataggccaggttaacgtttctagcgtctcacaatcaacacagatgatttcgcaggctctgtca

SEQ ID NO: 8 - DNA, 603 bp, Artificial Sequence
  Description of Artificial Sequence: Synthetic polynucleotide
ggtagtgctacctcatcaacaactactactacaaccgtatccaagagtgcagctgctgcagcggctgccgcagccgccgcgtcctccgcttcatctgcttccagagacagcgataggtcctcgagcgcagcaaaagcatacgcatcgtccagtgccaatgcttcttcgaacttcgaaaactaccaaacttctgacctaagcaggccatacgcaacttcctctaacgctccggcatctacgtcaggtatcaagaacgacttatcccctctgatttccggtttaatatcgtctagttctggtttgggttcatctgatgcatccgaccgcatctcatatttgttaacctccttgttgtctgtcattaattcagagggaggaagaatagatttcgcagcggttgcgaacattctcgtaagtttggttagcgagataagagccaagaatagtgaattgtcatacttccacatcttgattgaggcactattcgaggttttgtctgccgttctacaaattatttcttcttctcatatcgttatcggtaatgctagtttttcaagctcttctaacctagcctttgccgatgcatgtgccaaggcattctca

SEQ ID NO: 9 - DNA, 561 bp, Artificial Sequence
  Description of Artificial Sequence: Synthetic polynucleotide
ggttctgctgaggcttcctctgttgcccgtttgagttctgcatcaaatgacgtctatggcccaaccgctgaagaatttggtgcatcaggaagtgcgctcggtgtgtcccagtacggtgaattcggaggattggacgaagtcagtggaccagcacttcagagcactagtccgcccttcctaccactgacctccgacattggtcgcttcagcccagagatttctaggctgctctcgagcccaagcggactcacatccgaggcagctaaggaaagaatatcatccattattgcctctttgctcagcgctaaatcgtctcaagattttaatgccctcttactgtctaacatccttccatccttaatatccaaaattagccaaagagcatccggactttctccaaccgaaatggtgacggaagccctccttgaagtgctagcaggatgtatggaaatcttgtctagctttaatgtgggtgctcagtccattagtagtagtcgtacttcttcaaatgcacttgttcagtctataagtaaccaatttagtggtctgaacgctgctgca

SEQ ID NO: 10 - DNA, 516 bp, Artificial Sequence
  Description of Artificial Sequence: Synthetic polynucleotide
ggtgcttcttccgctgaaagtcgtaccagtgctgctcagtccggaacctcaggttctgcattaggagtcagtctatatggaggcagtggcagcttctatcaaggtaccgcaccggagttgctttctacatcccctgcctcatctcctgtagtgtcagacattggtccagaactgagctctttgctgtctgcacccacaggtctgacttctgaagcagctaaggaaagaatagctagtattattccatcgttactatccgctatttcgccaaacgagttcgacgcagttttattgtctgattccctagcttccttaataagccaaataagtcaatcaggaagcggtcttagtacgtctcagatcgccatggaagctctgttggaggtgttagcaggatgtatggaaatactgtcgagctcgaatgtcggtgccgcctcagtttcttcttctagggcttcatcgaacgccttggtgcagagtatctcaaacgcattcagtggcttaaacgcggccgca

SEQ ID NO: 11 - DNA, 537 bp, Artificial Sequence
  Description of Artificial Sequence: Synthetic polynucleotide
ggtagagccgttgcaagtggagcagccggatctggagcatcatctgccgctagatctggtgcgtctggatctgcatcaggtgtagcgaagtacggaggatacggtggatccagtgatctgagcggcccagccttccctaagattagcccagtctctttgccccatattcctgacggacgtccattcctgccggtaacatctgacctactctcgagtcctgctgatttaactagtccagccgcaaatcaaagaatcacttctataattcccattttgagatcaggtatctcacctaagggattcgatgcatcactgttagccgactccttatcaagtttgatttctgaaatttcacagtctgcttcagagcttagcgcttctgatgtactaaccgaggctctacttgaattagtctccgcgttccttcaaattttaagttccgatgctggtagtgttggtatatcgagttctacagctttctcaaatgctctagctcaatcagtttctaatgctttctatggtctgaacactgttgca

SEQ ID NO: 12 - DNA, 456 bp, Artificial Sequence
  Description of Artificial Sequence: Synthetic polynucleotide
ggtgcaggagttggagctggagttggtgcgggtgcaggtgctggcttcggtgctggcgttggcgccggagtaggagcaggatatggagctggcctgggtgctggatctggagtcggttatggatcaggatcctccattgtttctacttctggaggtgattttagcacaactcttagttcagcttcctcagttttagcaagcccacaaagcgtcacaagggtatccgctttggtccctaaccttatttcaggaggatcttttaattccaacgcagtttcagctgtgctgccaggattgacatctcaaatcaaggctgccacaggttctaatggatgcgactcattcgtgatcgcgttgttggagattgttagcgctttaggccatcttcttaataactctatgatcaacgttaacgccgcaagcgttcctgtgtcccctccacaatggctttactca

SEQ ID NO: 13 - DNA, 531 bp, Artificial Sequence
  Description of Artificial Sequence: Synthetic polynucleotide
ggtgctggagttggcgcaggagccggagcaggagctggtgctggtgtaggtgccggtttcggtgcaggtgttggtgctggcgtcggtgccggagccggtgcaggagttggagctggcgtgggcgctggtgcaggagctggattcggagccggtgttggagccggagtaggagcaggtgtcggtgctggatacggcgccggactgggttcaggcgtcggtgcctccttcggtggcgactttcgtacaacgctgtctagtgcaagtagtgttcttgcaagtcctcagtctctgactagagttaacaccctagttccatcattaatctcaggaggatcatttaatagtaatgctgtttcacgtgccttatccgatcttaactcccaaaatcgcgccgctggtagtacgggttgtgattctactattcaaacattgtttgagatggtttctgctatggaccatatccttaagaactccattatctcagataccgctgcttccgttccagtttcccctccacaatggttatattca

SEQ ID NO: 14 - DNA, 486 bp, Artificial Sequence
  Description of Artificial Sequence: Synthetic polynucleotide
ggtgctagttcctctgctgcggctgcagctgctaccggtggaggtggagccggtggttacggaccaggtataggtggaggctatggtccagcttctccgactggtaccggttccggactgggttccggcgcaggagcagtatcccctgcaagtggaactggtttaggtggatatggaggaggatccttggaatcttctataagtggtctaagttcacaagccagcgccacacgcgtttctagcctgtcctcttcactcacttcaggtggcactcttaatctggccgcgttaccaaatcaactacaacaatccgccagtgaaatatcagttagttccccaggtgcatctagctgtggcacaatggtgcagttactgttggaattgtcatactctctgatctatgccttgagtagtgcatacggtaccgacgcttcttacgttaacgaggcaatgaacaacatattccatattttgaatgcctttcca

SEQ ID NO: 15 - DNA, 408 bp, Artificial Sequence
  Description of Artificial Sequence: Synthetic polynucleotide
ggtgccggaggtgccggtggcggacaaggaggatacggtggtcaaggtggttacggtcagggtacaggagcaggtggagcctcatccgctggtcttagcgtcacagttggaaatatggtttcacgtctgtcgtctccggaagctgcctcgcgcgtatcctccgcggtgtcctccctagttagtaacggccaagtgaacgttgacgcactacctagcataataagtaatttatcttctagtatcagcgcaagtgccactaccgcttcagactgcgaggttttggttcaggtacttcttgaagttgttagtgcattagttcagattgtctgttctgccaacgtcggttacattaatccggaggcatctggctctcttaacgcagtaggttcagccttggcagctatggga

SEQ ID NO: 16 - DNA, 717 bp, Artificial Sequence
  Description of Artificial Sequence: Synthetic polynucleotide
ggtgcttatgcatacgcttacgccattgcaaacgctttcgcctcaatcttggctaatactggactactcagtgtttcttcagctgctagtgtcgcttcatccgttgcctccgccatagcaaccagtgtaagttctagttccgccgctgcagccgcttccgcatccgcagctgcagctgcatcagccggtgctagtgctgccagttctgcatccgcctcttcttcagcaagcgctgccgcaggtgctggagcgggtgctggtgccggagccagcggcgcatccggtgctgctggcggatcaggcggtttcggtctgagttcaggtttcggtgcaggtatcggtggtttgggtggatatccatccggagctcttggaggcttgggaataccatccggtctgctatcttcaggattactatctccagctgccaaccagagaatagcaagtctaattcctttgattttaagtgccatttcacctaacggtgttaacttcggtgtcatcggctccaacattgcatcactagcgagtcaaatctctcaaagtggtggtggtatcgctgcttctcaggcttttactcaagctctcctagaattggtggcagcatttatacaagttctttctagtgcacaaattggtgcagtgtcgtcatcttctgcttctgcaggtgctacggccaatgcattcgctcaatctctgtcctcggcattcgcagga

SEQ ID NO: 17 - DNA, 438 bp, Artificial Sequence
  Description of Artificial Sequence: Synthetic polynucleotide
ggtgcaggagctggtgctggttcaggtgccggtgcgggagcgggtgctggtgccggtagcggtgcctcaacctcggtcagtacatcttcatcgtctgccgctggagctggagccggcgccggaagtggtgcaggagccggctcgggtactggtgcaggcatagccctcccatcaatcgtattgtcacctgctgcatcttctagaatttcttcggtttcttcatctgtacaatctgctggatcgggattgagttttagctcattgagtaatacattatcacaaacagcaagcgctatacgtagctcaaatccacagctgtcctcttctgacgttctcatccaatctttggtcgaaattattgttggactggttcaagcatttactggatcttcagcttcagcgcaaacgttcgtaaactccctgtcacaggtggccgga

SEQ ID NO: 18 - DNA, 552 bp, Artificial Sequence
  Description of Artificial Sequence: Synthetic polynucleotide
ggtcagggaacagatagttcggcttcgagcgtctcgacatcaacttcagttagttcatctgcgacaggacctggttcgagatatcctgtaatggactacggtgctgatcaggctgaagcggcagcctcagctgctgcagcagcagctgccgaagcagctactattgctggactggattacgaaggtcagggacagggcacagattcaggtgcctcatccgtttcttcttctacatcggtaagttcctcagcaacaggtgttacgcagactactatagcgctgcctccagatgtcagtgccagaatttcgttcctcacttcctacttgcagtcagccggttccggattatcactctacactctatctaatttgttgtctcaaaccgctttggccatttctaaatctcgacctgaactgagtccaaacgaggtactgattcaaagtctagcagagattattgtagctcttgtgcaagcattgacaaagcaagctagttcttccgccagtgtgcagtacttcggaagattcaattctttgagtcaggtcgcggga

SEQ ID NO: 19 - DNA, 396 bp, Artificial Sequence
  Description of Artificial Sequence: Synthetic polynucleotide
ggtactgtcgctgagagtggtagtactgctgcctcttcgtcctacgccgcagcggccgcggctagttcctctgctggcagcacatcgtccccgtcgtttctaagtgctgattcactgagttcgtcccttgcttctttaagaatctgttcattctcatccaaattgatgtctagtttgtacagtggagatggtttggacattgctgaattttcagacgcagtgtcatccatggtatccagcattaagtctagcaaccctggagtatcagcttctcagatactgacggaactactgtttgaggtaattgttgcctttgttcaggccttgactaaaagcaaattttccacaatggagacagccgagtcgcttattgctgcttttgctcaagctttcgta

SEQ ID NO: 20 - DNA, 579 bp, Artificial Sequence
  Description of Artificial Sequence: Synthetic polynucleotide
ggtccaaaggaagaacctttgggtgaaagctcagttattgctactagcgtttctgccgcttcttctgttagttctggtggcgctccaggcgtacagggtggaggcccagtgacagtgtcatacagagaaggaccttctcaaattcctagtcaacaaaccttacttcaagccgttcctagcacgcaaagtgttggatccggtgtaccggttggtccgaaccaatatgaaatggtttacgcaccactgcaacagtttggtggtgtttcagcttcaaacttgctttcaccttccgcacactcaagaatcgcatccctgatgtcagacgttctttcattgttttctccaggtaactctggattcaactatggaggattcgcaagggctctttcttcagttgccagagccgtaagccaatctaatgctaagctttcgactactgatgttatcatccaggtccttatggaagcattagtggctttaatagagctgttgtccggtgctaagatcggagtggtccacccagttagagcccaagcgggtgcaagcgcatttgcacaacactttggatctgctttcgga

SEQ ID NO: 21 - DNA, 708 bp, Artificial Sequence
  Description of Artificial Sequence: Synthetic polynucleotide
ggttctttgggataccaactagccctacaaagggctaactctttgggcataccgaatgccgcttctgtggctggcgcagtagctgaagcggtttctgcagtgggtgtcggagctagctcatacgcttatgcctctgcaatttcaaacgcagttggtccgttgttgatatcgcagggactgctgtctcagtccaacgcttcagcgttggcgagttctttcgcatcagcatttgcggctagtgctgtaagtagctcgtctagttctggttctacttcacaaacattgggttcatacttattgggaactcgacctgctttatcaagcaggcttggcttgttgaatttgcctagcagtgttgccgtaactagacctgcctttgtgtccttgatatcacctgtgctatcctctgaaaccggtctatcttctgcgtctgcctctagtagagtcaacagtctggccagttctgttgcctcagccatagctagcggccaggccttaagcgctgactctttcgctaagtcgctattgatacaagcctctcagattcagagttcggctccaagttttaaggcagatgacgttgttcatgagtcacttttggaaggtattagtgctcttattcaagtaataaactctagttatggaagcccactatccctaagtaatgcacaaaccgttaatgctggtctggttaattacttcttggta

SEQ ID NO: 22 - DNA, 615 bp, Artificial Sequence
  Description of Artificial Sequence: Synthetic polynucleotide
ggtaatgttggctaccaattgggtctaaaagttgctaattccctaggactaggtaacgctcaggctctggcatcccaaggcattttgaacgcggccaatgcaggatccctagcatcctcttttgccagtgcgcttagcgcttctgcaggctcggtgggaaacaggtcgagcgcgggaccatctgccgtcggactgggaggtgtatcagccgtgccaggatttattagcgctaccccggtggttggaggtccggtgactgttaatggtcaggtactaccggccgccttacagacggctttggcccctgttgtgacatccagcggattggcatcctcagcagcttctgccagagtgagttcgttagcacaaagtatagcatccgcgatctcttcttctggcggtacattatctgtccctatattcttgaatctcttatccagtgcaggcgcacaagcgactgcttcctcatccctctcttcgagtcaagtaacgtctcaagtattattggaaggaattgctgccttgttgcaagtcattaatggtgcccaaattagatccgttaacttagctaatgtgcctaacgttcaacaagcccttgtttctgctctatctgga

SEQ ID NO: 23 - DNA, 714 bp, Artificial Sequence
  Description of Artificial Sequence: Synthetic polynucleotide
ggtaacgttgcgtatcagctaggctttaacgttgcaaacaccttaggattgggcaacgcagccggtctaggtgcagctttaagtcaggccgttagttccgtgggtgtcggagcttcttctgcgacctatgctaacgcagtatcgaatgctgttggtcagttcttggccggtcagggaattttaaatgcggcaaatgcagcatccctggctacttcctttgccaacgctgtgtcatcaagtgcattggcggccgtttcaagaatcagctcgccatcttacggtgcttttgcatctgttccaaaattcgttccaagtaacttgaatgcgggcggagtctccttcggagaacctttcgctgcattatcccaatccgtgccgacagacttacagagcgcccttgctccaattgcttcctcttctggactgggatcttccgctgcctcagccagagtgtctagtttagcgaatagtgtcgcatcagctatttcgtcgtcaggcggatctttgtctgtccctacattcctaaattttctttcctcagtaggagctcaagtttctagctcttcatctttaaattcgtcagaggttacgaacgaggtcttgttggaagcgattgccgctctgctccaagtgctcaacggagcccagataaccagcgtaaatttgagaaacgttccaaacgcccagcaggcacttgttcaagcactatcggga

SEQ ID NO: 24 - DNA, 510 bp, Artificial Sequence
  Description of Artificial Sequence: Synthetic polynucleotide
ggttctctagctagttcttttgctaacgctttatccaactcggctttgagtgtaggatctagagtaagttccccttcttatggagcattgagtccaatagctgctggtccaaactttatatcaactggactgaatgtcggaggtccatttacaaccttgagtcaaagtttgccaacctccctccagacagctttggctccaatcgtatcctcttccggacttggtagttcagcagctacagccagagttcgtagtttggctaatagtatcgctagtgctatcagttcttctggtggttctctgagcgtcccagcctttcttaacctactaagtagtgttggagcccaggtttcgtcatcttcctctcttaattccagtgaagttactaatgaagtactgctggaggctattgccgcactattgcaagtaatcaacggaggtagcattacgagtgttgacctcagaaacgttccaaacgcccaacaggatttggtcaatgctctatccgga

SEQ ID NO: 25 - DNA, 723 bp, Artificial Sequence
  Description of Artificial Sequence: Synthetic polynucleotide
ggtaatgtcggataccaactgggttttaatgtcgctaatacgcttggaatcggaaacgctcctggtctaggaaatgccttatctcaggctgtatccagtgtaggagttggagcttcctcatcagcctatgccaacgctgtttctaatgcggttggtcaattcttagccggtcaaggagttctaaacgctggcaatgctggttcactagctagctcattcgccaacgcactgtctaactcagctctgtcagttggaagtagagttagcagtccatcttacggtgctctatccccaatcgcagctggtccaaatttcatttctacgggattaaatgttggtggtgcttcggttggtggaccgtttgactctcttagccaatccttgcctacctctttgcagactgcactggctcctatcgtctcctcttctggactgggatcaagtgccgctacagcaagggtatcatctctggcaaactccttcgccagcgcaataagctcctcaggtggctcattaagtgtgccaacattcttgaatctgctgagttccgtcggtgcccaagtatcaagttcttcatccctgtcgtcccttgaagtgactaacgaagttttattggaagcgatagccgcactactacaggttattaacggcggttctattaccagcgttgatcttagatacgtacctaacgctcaacaagacctggtaaacgcactctctgga

SEQ ID NO: 26 - DNA, 537 bp, Artificial Sequence
  Description of Artificial Sequence: Synthetic polynucleotide
ggttccctagccagcagttttgcctcagccctgtccaactccgctctatcaattggatcaagggtcagttctcctagctacggagttttcagcccaatagccgccggtccaaatagcatctccacaggtttgaacgttggcggagcttctattggtggtccttttgctactttgtcacaaagtttaccgacttccctgcaaactgctttggctcctatagttagttcctcgggactaggatcttctgcagctactgcaagagtgagttcactcgctaatagtatcgcatcagccatctcctcatcaggtggatctctgagtgtgccaacctttttaaacctactgtcatctattggagcccaagtctcgagttcatcctcattgtcctcctcttctgaagtgactactcaggtcttattggaggctatcgcagctctactgcaggtgattaatggtgcccaaatcacttcagttaacttctccaatgtctccaacgtcaatagagcattggtagattctttggttggatccttcgca

SEQ ID NO: 27 - DNA, 603 bp, Artificial Sequence
  Description of Artificial Sequence: Synthetic polynucleotide
ggttcggcaacctcatccactaccaccaccacaactgtttcaaagtcggccgcggcggccgcagctgccgccgccgctgctagttcagcgagttcggcttccagagatagtgacagatcaagttccgccgctaaagcgtatgcctcttcctcagcaaatgcttcttcaaatttcgagaactaccagacctctgatctctctagaccctacgccacttcgagcaacgctcctgcatctacctcgggcatcaagaacgacttgtctcctttgatctcaggattgatctcctctagctctggtcttggctcttcagacgcctcagatagaatatcatacttattaacatccctactgtcagttataaactcagaaggtggtaggattgacttcgctgccgttgcgaatattcttgttagtctcgttagtgagatcagagccaagaattccgaactttcttactttcacattttgatcgaggcactgttcgaggtactcagcgccgtattacagatcatttcttcatctcatatagttataggaaacgcatcgttctccagcagctcaaacctggcattcgccgatgcatgtgcaaaggctttttca

SEQ ID NO: 28 - DNA, 807 bp, Artificial Sequence
  Description of Artificial Sequence: Synthetic polynucleotide
ggttcttttgcttctgctagcgcttacgctttcgcttttgccagtgcattttctcaggttctttccaactacggtctgctgaacataaacaatgcttattcattggcatctagcattgccaatgctgcctcaacttcagcttcctcagccgctgccgcagccgtagtagcatctagttcaagtgctgccaccgcagctggtgcagcatccacatctgtcccagcaacaagtttgtccagtgccactagagtcggtggttctttgtcctctgctgtttcacctgcctccgcaaggacggccacaggtgatggtacaacgtacttgccagtccagattcagccaggaatcggtttcgtcccaagtctgtctggagatattggaccaaacgtcccaggatccggaggatttggatcccccgctttacctagtccagtgtatggacctgcaatcctgggcccaggactcgttgcacctgccctggcaaatttgctaccacctttgtccgttcttcctagtgattctgccaacgaaaggatatcatcggttgtttcttctctgttgtcagccatttctagcaacggactggacgcatcctcattaggtggaacgattgcctccctcgtaagtcaaatctctgtttcaaatgccaaactttcatctagccaagtgttcttggaagccctactcgaagtgctttctggaatggtccagatcctcagctacgctgaggttggcgctgttaataccgataccgtaatctcaactagttcagctgttgctcaggccatatcgagcgcggtttccgga

SEQ ID NO: 29 - DNA, 660 bp, Artificial Sequence
  Description of Artificial Sequence: Synthetic polynucleotide
ggtgcttctgcatcagcctacgcctcagcttttggctctgctattggacaatacttggcgggtatcggtatcatttcccaatccaatgcaagtgctctagctagttccttcgcatcagctatctcaagtgctgcgggctcactttcactgggtggtccattcggtgtatccggattgggtattggtggtttgccagttggagtctcgcctgtcggagtcgtcggtccagcaggagtctacggtccggcaggtctttacggacctggagtggtgggttccttaggaccagttacaccattgaacgtaatatatccttctttaacaacctcgattgccccaattattgtgggacctgccggactgagttcggcagcagctacttctagggcttcgtcccttgcttctagtgtcgcatcggccattagcagtgcaggatcggcaggtggtgtggatgtgggactgtttgcttctggattatcaagtctagtaagtcagattcagtcatctaatttaggtctgcagccggaccaggtgctgctagaggctttactggagggatactcggctctagcccaggttcttatttcaagccagatttcgtctgtttctgtctcatcatcatccgcactaggtccagcgttgttgaattacttggtcgga

SEQ ID NO: 30 - DNA, 537 bp, Artificial Sequence
  Description of Artificial Sequence: Synthetic polynucleotide
ggtattctgacgcaggagaacgcctcttcacttgcgtcgtcagtagctaatgctctcagtgcttcatctctgttggttccatctgctataagcaccggtgtacctggactaattgttggtccgtctattgtatcctctttgaacgccccaatagcaggtttcgcagtcccgggcgtagcccaggtcattgtccccacagcctattccaccttactagcaccagtattatccccagccggattggcgtctacagctgctacttccagaatcaacgatattgctcagagcctttcatcgaccctctcaagcggatcacaattggcgcctgacaacgtcctacctggtctaatacaattgagcagttctattcagtcaggaaatcctgacttggatcctgctggagttctcattgaaagtttgttagagtacactagcgccttgcttgctctgctgcagaatgcccaaatcacaacatacgatgccgctacgttgccggcattcaacactgcactagtgaattatctcgtgccactcgta

SEQ ID NO: 31 - DNA, 567 bp, Artificial Sequence
  Description of Artificial Sequence: Synthetic polynucleotide
ggtgttttgaacgccgtcaacgcatcatcactgggttcggccctagccaacgcactgtcggactctgctgcaaactcagccgtaagtggaaactacttgggagtatctcagaatttcggaagaattgccccggtaaccggaggaacggccggaatttcagtgggtgtgcctggctatcttcgaacaccaagctcaactatccttgcccctagtaacgcccaaattatttcacttggtttacaaactaccttagctccagttctgtcgagttccggtttatcttcagcgtctgcatcggctagggtgtcctctcttgcccaatctctcgcctctgccttgagcacatccagaggtactttaagtttatcgacatttttgaatttattatcatccatttcgtctgagatcagagcttccacatctctggacggtactcaggcaaccgtagaagtgttgttggaagcactggctgcactactgcaagtgataaacggtgcccagattactgatgtcaacgtctcttcggttccaagcgtcaatgctgcgctcgtttccgcacttgtagca

SEQ ID NO: 32 - DNA, 696 bp, Artificial Sequence
  Description of Artificial Sequence: Synthetic polynucleotide
ggtatcgccagtgatacggcgctcgccggtgcactggctcaagctgtcgctggcgttggtgctggagcctctgcttctacatatgccaatgttattgccagggcggctggacagttccttgcaacccagggtgtcctaaatgccggcaacgcatccgcattgggatccgccctcgcaaacgctcttagtgacagtgcagccaactcagccgttagtggaaactatgtgggcgcctcccagaatttcggaagaatcgcacccgtcactggaggaactgccggtatatcggttggagttcctggtttcttaagaacaccagcttctaccattttagtcccttcaaatgctcagatcatctcacctagcttacagacaactctggcacctgttctctcttccagtggactgagttcggcctcagcgtcagcacgtgtcggatccctggcacagtccttggcatcggcactctcaacatcgagaggaactttgtcattgtctaccttcctgaacttgttatcaccgattagctcggagattagagcaaatacgtctttggatggcacgcaggcaaccgtggaagctttgttggaggctctagccgctcttttgcaagttataaatggagcccagattactgatgttaatgtttctagcgtaccatcggtaaacgctgcgttggctagtgctttggttgca

SEQ ID NO: 33 - DNA, 630 bp, Artificial Sequence
  Description of Artificial Sequence: Synthetic polynucleotide
ggtgccactgctgcttcctacggaaatgccttgtctacagccgccggacaattttttgctgcccaaggactactaaatgctggtaatgtatcgagtctggcttccgccttagcgaatgctctcagctatagcgctgctaattccgccgcttctggtaattacattggagtttcacaaaattttggtagcattgctccggtcgctggtacagctggtatctcagttggagtaccaggcctattgcccacatctgccggcacggtgctcgctccagcaaatgcgcaaattattgcgccaggcttacaaacaactctagcaccagtcttttcaagtagtggtttgtcatctgcctccgctaatgcaagagtctcctcactggcacagtcgtttgcttctgctttgagtgcttcacgcggaacgttgagtgtatctacttttctaaccttattatccccaatttcatcacaaattagagcaaacacaagtctagatggaactcaagcaactgtgcaagttttgcttgaggctctggccgccttgctccaagttattaatgcagctcagattaccgaagtcaatgtgagtaacgtatctagcgccaatgctgcgttggtttcagcactggctgga

SEQ ID NO: 34 - DNA, 582 bp, Artificial Sequence
  Description of Artificial Sequence: Synthetic polynucleotide
ggtcaatttcttgccaatcagggcatcctgaacacaggtaatgctagttcactggcatcatcgtttagtaatgctttaagttcaagtgctgctaatagtgtcggatcaggattgttgctgggtccaagtcaatacgttggttctattgcacctagtattggtggtgctgccggtatctccatagctggacctggaatcctttcctacttgccaccagtttctccactgaatgctcagatcatatcgtcaggtcttttagcctcgctcgcaccggtgctgagttcttcaggtttggcttccagctcggctacctcaagggtcggttctctggctcaatcccttgccagtgcattacagtcgtccggcggaactctcgatgtatctactttcctgaatttgttatcaccaatttctacccagatacaagctaatacctcattgaatgcctctcaagccatagtccaagttttgttggaagccgtggcggcattattgcaaattatcaatggtgcacaaataacgtctgttaatttcggatcggttagttcagtaaacactgcattggccaccgcattggctgga

SEQ ID NO: 35 - DNA, 951 bp, Artificial Sequence
  Description of Artificial Sequence: Synthetic polynucleotide
ggtagtcagtcagcttcacaggctgccgcatcatcgagtgcttctgccagcgcttctgcaagtgcattcgctcaatctgcttctctggcactggctagctctagctcattcgcctcagcaatttcctcagtctccagtgtaagttccctaggatctttgggctatcaggtaggtttgcaagcagccggcagtctgggcatcagtaactcgcaggctttcgcttcctctatctcacaagctcttacatcagtgggtgtcggagctagttccgccgcatacgcttccgcagttagtggtgtcgtcgcccaataccttagcggcaccggagtcctttcatccgccaatgcccaggctttggcctctagttttgccaacgtttttgctgctagcgctgcttctgcatcagctgcaacctccgcctcctcttctgcctcagctcagagcgcagcagcagcattaacgcagaaccaatccgctgcctctgctttcagccaggcagctagtcaagctggttcacaagccagttctcaagccggaagtcaagttgccagccaatctgctagtggtctgggtgctttcggttttggtactagtgcatctggcattataacgagctctccatctttggctaatctggtttcgaacgtcgctccgatactcctgtcctctaacggtttgagctcttcttcagcaagttcgagaataaattccattgcatcaggtctttcaactgccttatcgagctcgagaggcgtgtctctcgagaatttgtcctcatccttatcatctgtatttagcgagatccaaaacaattctttcggtgtctccgcagaacaagccttgatacaagcattgtttgaggtattaacaggtaccgtacaagtgcttaataggggtcagacatcgtttgtttccgtatcttcccctacagttataagctcatcgttctca

SEQ ID NO: 36 - DNA, 657 bp, Artificial Sequence
  Description of Artificial Sequence: Synthetic polynucleotide
ggtgctgccgctactgccggagcgggagcctccgtagcaggaggatatggcggcggtgcaggtgcagctgctggagcaggcgcaggtggatatggcggtggatatggtgctgtagctggttcaggcgctggtgcagccgccgccgcttcttcgggagctggtggtgccgctggatatggtcgtggctacggcgccggttctggtgctggagctggcgcaggtactgtagctgcatacggaggtgctggtggagttgccacctcatcatcttctgctaccgcctcaggtagcagaatcgttacctctggtggatacggttatggtacttcagctgcagcaggtgccggcgttgccgcaggaagttatgcaggcgctgtcaaccgattgagctctgctgaagctgcttctcgagtttcctccaatatagctgctattgcatccggtggagctagcgcactgccaagcgttatatctaacatctacagcggcgtcgttgctagtggtgtaagctctaatgaggccctgattcaagctttgcttgagttattatctgcattggttcacgtattatcgtcggcttcgatcggtaatgtatcttcagtaggtgtggactcaactctcaatgtagtgcaggacagtgttggacaatatgttgga

SEQ ID NO: 37 - DNA, 489 bp, Artificial Sequence
  Description of Artificial Sequence: Synthetic polynucleotide
ggtgcttatggtggaggatatggaggaggagctgcagttggtcgtggtattacctacggttcagcaagcagttccgccacatcgtcctcaactgcaacttcttccggttctacggccttaactagtgctggatacggaagcggagttggtgtctcagctggagccggagccggcgcagccagcgctggaggttcttactctggatcagtttcaagactttcttccgcagaagcagtgtctcgtgtttcttccaatattggtgctattgcttccggtggtgccagtgcattaccgggagttattagtaatatcttctcgggtgtctccgcatccgctggctcctacgaagaggctgtcattcaaagtctattggaggtgttgtctgcgttactgcacatcctctccaacagctcaattggttacgttggagcggatggcctaacagacagcctagctgttgtgcagcaagctatgggtcctgtagttgga

SEQ ID NO: 38 - DNA, 396 bp, Artificial Sequence
  Description of Artificial Sequence: Synthetic polynucleotide
ggtgcaggaagcggttctcagggagttggttctggatccaattatggtcaattctcttcacaggacgtctcaggtgctgtcttagcttccacgtctagattggcatcaggtcaggccacggaccgagttaaagatgttgtcagcaccttggtgtcaaacggcattaatggcgacgctttaagcaacgccatttcaaatgttatgacacaggttaacgctgctgtcccaggactttcgttttgtgagaggttgattcaagtgctacttgaaatcgtggctgccttggtacatatcttgtctagcagcaatgtcggatcaatcgactacggctccacatcaagaactgccattggagtttccaatgcattggcttccgctgtggcgggtgccttctca

SEQ ID NO: 39 - DNA, 540 bp, Artificial Sequence
  Description of Artificial Sequence: Synthetic polynucleotide
ggttcaggttcagcctcagtctctactggcggctacggacaaagccaagttgccagagcatcctcttcgagcgccgtaggaaccagctcttccgtctccacatctggcagctctggatatagccaggtcagtggtggatacggacagtcatccgccgtgggacaagcatctgctggttacggtcaaatgcagtcaggagttgctgtttccggtggttctgctagcgctacaatttcaagtgcagctagccgtttgagttctccaagctcttctagtagaatcagctccgcagcttcttcgctggctaccggaggtgtcttgaattccgctgccctaccaagtgtcgtcagtaatattatgtcccaagtttccgcttcaagtccgggtatgtcctcttctgaagtcgtgattcaagccttgttggaattagtgtctagtttgattcatatcttgtcctcagctaacataggacaagtagactttaacagtgtgggaaacaccgcagccgttgtgggtcagagtttaggcgccgccctagga

SEQ ID NO: 40 - DNA, 438 bp, Artificial Sequence
  Description of Artificial Sequence: Synthetic polynucleotide
ggttatggctcctcatcttcagtgagctccagttcctctgccgccagttctagcacatccggtgtcgtaacatcaggtggttacggctatggtgccggtgcagcagcaggagcgggagctggcgcaggtgcgtcagccggctcttattctggtgctgttaacaggctcagttcagctgaagctgcttcgagagtatcttccaacgtagctgctttggctagcggaggtccagcagccttagccaacgtcatgggtaatatttacagcggagtcgcttcttcaggagtttcttccggtgaggctttagtacaagctttgcttgaagtcatcagcgctctagtccacctgctgtccaatgcgtcaattggtaatgtctcttcggctggtctaggtaacacaatgagcctcgttcaaagcacggttggagcttatgctgga

SEQ ID NO: 41 - DNA, 450 bp, Artificial Sequence
  Description of Artificial Sequence: Synthetic polynucleotide
ggtgctggtgcgggtgcaaccggcggatatggacggggagccggtgctggtgcaacgaacgcaggcggttatggtggtcaaggtggttacggagctggagccagagccttcgcaggtgcgggagtgggcgttggaacaaccgtagcaagtacaacttcaagattgtccactgccgaagcttcgtcacgtatctctacagctgcctccacgctagtttctggaggttacttgaacactgctgctctaccttctgttatcgcggatctttttgctcaagtcggagcttcctcgcctggagtgagcgattcagaagttttaattcaggttttgcttgagattgtctccagcctaattcacatcctatcttccagttccgttggacaagtcgatttcagttctgttggtagttctgctgcagcagtaggtcaatcaatgcaagtcgttatggga

SEQ ID NO: 42 - DNA, 480 bp, Artificial Sequence
  Description of Artificial Sequence: Synthetic polynucleotide
ggtgccggtgcaggacgcggaggttacggtcgcggagctggagcgggcggttatggtggacaaggaggctacggtgcaggtgctggagccggtgcggccgccgctgccggagctggtgccggtggttacggagataaagagatagcctgttggtcaagatgtcgctataccgttgcttctactacttctcgactttcttctgcagaagcttcgagcagaatttcttctgccgcatcgacattagtcagtggtggttaccttaacactgcagctttgccttccgttatctctgatttattcgcccaagtcggagcatcgtcaccaggagtatcagattccgaagttttgatccaggttctattggaaatcgtatcctccttgatacatattttatcctcatcttctgttggacaagttgacttcagctcggttggtagtagcgctgctgctgttggccaatcaatgcaagtagttatggga

SEQ ID NO: 43 - DNA, 624 bp, Artificial Sequence
  Description of Artificial Sequence: Synthetic polynucleotide
ggtgcaggagcaggaggcaccggaggatatggtcgaggttccggcgcaggtgctgctgctggagctgcagcaggagccggagccgcaggaggatacggaggttatggagcaggagcgggtgctggagctggtggagccagaggttacggaggaggagctggcgccggcgccggagctgctgcgggtggttatggcagaagggcgggtggatcgattgttggtacgggaattagtgcaatttcctcaggcaccggaagttcttattccgtctcctcaggtggttacgcttctgcaggcgtaggagtcggatccacggttgccagcacaacctcacgcttatcgtcagcccaagcctcaagtcgtatcagcgctgcagcctcgactcttatttccggtggttaccttaacactagtgcccttccttccgtcatttccgatttatttgcccaagtatccgcaagctctcctggtgtatctgactccgaagttctaattcaggtcctgcttgagatcgtaagctccctgatccatattctgtcgtcgagctcagtcggacaagtagacttcaactccgtcggatcttcagctgctgccgtcggacagtctatgcaggttgtcatggga

SEQ ID NO: 44 - DNA, 651 bp, Artificial Sequence
  Description of Artificial Sequence: Synthetic polynucleotide
ggtgcaggagctggtggtggctacggaggaggttactctgcaggcggaggtgccggtgctggcagtggagctgctgcaggtgctggcgccggaagaggtggagctggcggctattccgctggagctggtacaggtgctggtgctgccgctggtgctggtacagctggtggatattcaggaggttacggtgctggcgcttcaagctcagctggttcttcctttatctctagttcgtccatgtctagttcccaagccactggttactcttcctctagcggctatggtggtggtgccgcgtctgccgcagctggagccggtgcagctgctggtggatatggtggtggttatggtgctggagccggcgctggtgccgcagctgcatctggcgctacaggtagggttgccaattctttaggtgcaatggccagtggaggtattaatgcattacctggagtgttttcaaatatctttagtcaagtttctgctgcctctggaggtgcatctggtggtgcagtattggtccaagcactaacagaagttatcgcattattgttacatattttatccagtgcttccattggaaacgtgtctagccaaggactggaaggatccatggccatagctcaacaagcaatcggagcgtacgctgga

SEQ ID NO: 45 - DNA, 564 bp, Artificial Sequence
  Description of Artificial Sequence: Synthetic polynucleotide
ggtgctgcctcttcccaagtcgtgtctaggaccactactacaacctcacaaagcgctgccggcggagctgcctctggttactctactggtgtaggaagtggtgctgccgcagccacctccggtgcaggttacggaggacaacgaggatacggtaccggagccggagccgcagctggagcagccgcttctggtacaggtgctggttacggtggacaagcaggctacggtcaaggtgcaggcgcatccgcagcagctgcagcctcagcggcatctaatagaattgttagtgccccagcggtgaacagaatgtctgctgcatcgtccactcttgtttccaatggcgcttttaatgtaggtgctttgggatcgaccatttccgatatggccgcccagattcaggctggaagtcagggtttgtctagcgctgaagctactgttcaagccctactcgaggtaattagcgtactgacacacatgttgtcaagcgccaatataggatatgttgatttcagtagagtcggtgatagcgctagtgctgtttcccaatcaatggcctacgccgga

SEQ ID NO: 46 - DNA, 495 bp, Artificial Sequence
  Description of Artificial Sequence: Synthetic polynucleotide
ggtggcccgggtggtccaggaggacctagaggagcttatgttccaggtgctggtggtttttccggcgtttcctcgggtgcgggtggtgtcagaggaggttccgtaatgccctccggtggatccggatctgcaggtccagtcactatcgtcgagaatattacagtaggtggaggtccatcgggaggttcgggtggagctgccggcggacaaacctaccaaacttatggtggtagtagcagactcccctctctagtcaatggattgatgggatccatgcaacctacgggatttaactaccaaaacttcggtaacgttctttctcaatatgctaccggatcgggtacatgtaattccaatgatgtaaatctgttgatggatgccctcatggctgctctacactgtttaagctacggatcaggttctgttccgtcaaccccgacttattctgccatgtcagcctacaaccaatctataagaaggatgttcacatactca

SEQ ID NO: 47 - DNA, 648 bp, Artificial Sequence
  Description of Artificial Sequence: Synthetic polynucleotide
ggtggagctggtggaccaggagcaggtggtgttggtccaggcggcgtaggcccaggtggagtgggacccggaggtatttatggaccaggtggagcaggtggcttgtacggtccaggtgcgggaggagccttcggatctggaggcggtgctggtgcacctggaggtccaggtggtcctggcggcccgggaggacctggtggtttgggcggaggcgttggcggtgccggcactggtggaggtgtcggaccaggagtcggcggtgttggacctagtggaggagctggaggaacaggtccagtgtcggtgtcgtctaccattacagttggtggaggacagtcgtccggtggagttttgccctctactagttacgccccgacaacatcaggatacgagagactacccaaccttattaatggtatcaaatcttcgatgcagggcggaggattcaactatcagaatttcggtaatattttgtcacagtatgcaactggatctggtacatgtaattactacgacattaatcttttaatggatgctctcttagctgcactacatactcttaactaccagggtgcatcgtatgttccttcttatccatctccatccgaaatgctatcatatactgaaaacgtaagaagatacttctca

SEQ ID NO: 48 - DNA, 498 bp, Artificial Sequence
  Description of Artificial Sequence: Synthetic polynucleotide
ggtggttatggcccaggcggatccggatcaggtggtgtaggcccgggtggttatggacctggtggatcgggtggtttctatggacccggaggaagtgaaggaccctatggtccttcaggcacctacggatctggaggtggatacggccctggaggagctggaggtccatatggaccaggatctccaggtggagcttatggtccaggttcgccaggaggagcttattacccttcctctcgagtccctgatatggtaaacggcattatgagtgccatgcaaggtagtggttttaattaccaaatgtttggaaatatgctttcgcaatatagttccggctctggaacttgtaacccaaataatgtaaatgtgctaatggatgctttattggcagctctgcattgtttatccaaccacggcagctcaagcttcgccccaagtccaactccagctgcaatgtctgcatacagtaatagtgttggacgtatgttcgcatactca

SEQ ID NO: 49 - DNA, 483 bp, Artificial Sequence
  Description of Artificial Sequence: Synthetic polynucleotide
ggtgccggaggatcaggcccaggaggtgccggtcccggaggagctggtccaggtggtgctggacctggaggtgctggtcctggtggagtgggtccaggcggagctggcggaccatatggtagcggaggattcggcttcggaggagccggtggtagtggaggaccttatgtcccaggaggcgcttatggagctggatctggtaccccttcgtattctggctcaagagttcctgacttagttaacggcattatgagatctatgcaaggcagtggatttaactatcagatgtttggtaatatgttgagcaagtacgcctcaggatcaggtgcttgcaattcaaacgatgttaatgtcctaatggatgcattactggctgctttgcactgtctctcatctcatggatcaccgtctttcggctcctctcccactccaagcgccatgaacgcctattcgaattctgtgagaagaatgttccaattttca

SEQ ID NO: 50 - DNA, 624 bp, Artificial Sequence
  Description of Artificial Sequence: Synthetic polynucleotide
ggtggttctggaccaggaggtgccggaggcagcggtcctggaggtgcaggaccgggtggtgtgggtccaggtggatccggaccgggaggtcttggatcaggaggttccggaccaggtggtgtaggtccgggaggttctggtccaggcggagtcggacctggtggttatggacctggaggatcaggaggattatatggacccggatcttacggaccaggcggttctggtgtcccttacggatcttctggaacttatggatccggtggtggttacggacctggaggtgctggtggagcttacggaccgggttcgcctggaggtgcatacggccctggatcaggaggctcctattacccttccagcagagtaccagacatggttaacggtatcatgtccgctatgcaaggatccggattcaattatcagatgttcggaaacatgttgtcacaatactcctcaggttccggaagctgtaatcctaataatgttaacgtactaatggatgctcttttggctgctcttcattgcctgtctaatcacggttcctccagttttgccccatctccaaccccagccgccatgtctgcgtacagtaactctgttggtcgaatgtttgcatactca

SEQ ID NO: 51 - DNA, 516 bp, Artificial Sequence
  Description of Artificial Sequence: Synthetic polynucleotide
ggtataaacgttgattcagacattggctctgtttccagcttgattttgtccggaagtacattgcagatgaccgcatctggtaaaggttcctaccctggaggagaaagtagtcaattcagtggtttggactctaatatcggcctggttggtacacaggatgttgctataggcgtgagtcaacctgtggatatctctttaaacaatatcctggactcccctcaaggattaaaaagtccacaagcatcttcgcgcattaaccgattatcctcctcggtggttaatgccttaggtcctaacggtctagacattaataactttagcgacggtttgcgcactactctgtcacagttgtcatctagcggactgagtaaaaaggaggctgctatcgaaactttaatggaagccatggttgcccttctgcaagtgcttaactctgcacaggtgaatcaggttgatacaagcagcacagtagttacctctagcagcttggctaaggccctgtcctccttgttttca

SEQ ID NO: 52 - DNA, 510 bp, Artificial Sequence
  Description of Artificial Sequence: Synthetic polynucleotide
ggtggcggagttggatctttcggaggacaaacttcatttggtcaaacctcgggtttgacttcctcagctgcttcgcaatctgacttcactcaagcctcaggatttgtgagttcggcaacaagccaaggcgcgtttggtcagacatccggtatcgcctcttttggcgctggaccaagtacaggacttagtgttagaagcacgttaaactcccctaatggtttgagaagcggttctgccgctgcgagaatctctcaactgacttccagcgtaaggaacgcgataggcccgaacggagtggatgctaacgcactggctagatctctacaggcttcgtttagtagtcttagatcttcaggaatgagttcaagtgatgccaagattgaagttttgttcgaaactatagtcggtctattacaacttttaagcaatacccaaattcgtggagttaatatggctactgctagctcagtggccaacagcgcagcccgatcatttgagcttgttcttgca

SEQ ID NO: 53 - DNA, 477 bp, Artificial Sequence
  Description of Artificial Sequence: Synthetic polynucleotide
ggtgctggatatacaggacctagtggtccatcaacaggtccaagtggataccctggaccactctcaggaggagcatcgtttggttctggacaatcaagttttggtcagacttcagcattctctgcttcgggagcaggccaatcggctggagttagtgtaatttcctcactcaactctcctgtgggcctgagatccgcttcagctgcttcaagactttcacaactgaccagcagtatcactaacgccgtcggtgcaaatggtgtcgatgccaacagcttagccagatctcttcaatccagcttttccgctttgcgatcgtctggtatgtctagttcagacgctaaaatcgaggttttattagagactatagttggtttgttacagttgttatcaaacactcaagtcagaggagtaaatcccgctactgcatcttcagttgcaaacagtgccgctagatcctttgaacttgttttagca

SEQ ID NO: 54 - DNA, 477 bp, Artificial Sequence
  Description of Artificial Sequence: Synthetic polynucleotide
ggttttgcaagagcatataccggtccacaaatatctcaacctgcaccacttggagtgggcccacaagtttcccaaccaaggccactaggtgtagcccctcaaacctccggtgcacgaccatttggaggtgtcactggtccttctgcaggaataagtttgggttccgcattgaatagtcctatcggtcttagatccggtctagcagcagccagaatctcacagctaacaagttctttgggaaacgcaatcacaccttacggtgtggatgctaatgctttagcatcttctttacaagcttcattttcaacattacagtcctcgggtatgtctgcctcagacgccaagattgaggttctgctggaaactattgtcggtttactacagttgttgtccaacacccaaattaggggagttaacatggcgaccgctagctcggttgcttcgtctgcagctaagagtttcgagttagtactttca

SEQ ID NO: 55 - DNA, 639 bp, Artificial Sequence
  Description of Artificial Sequence: Synthetic polynucleotide
ggtgcctctgctgcagatattgccactgcaatcgctgcttctgtcgccactagcctactttcctcgggttatctatcagattcaaatgcttctcaactcggtaattctctggcatcctctatctcttcagttgcattgaacgttgctgctgacttgggtgtctctttaagcgcaagtgcaaatttgtcgagctcacttggtgctagtgcaggtatatcctcctcattcgacgctagttccgcttcttccacatctctatcttcgtcgtcatctctctcttcgcaacaacaagtgacatcaagtgcagctgtatccttaaactccgttataactagtcctgtaggattggcgtccccacaggcctcgtctagagtcaggtatctgtcacaattggctttgaacgctatatcaccgcagggattcaatgtcgaagctttcgtatctcaattgggaacaatcatggcccaagctagagcaatgggtatgtcggcttctgacgctacgatagaaactttactcgaaggtttgcttagcctggtccaagcgttaggctcctgtcaggcaggtagttataatccagcaagatccgcggaagcctcaaacattttcctcagtgctattcagtctacgttgagttca

SEQ ID NO: 56 - DNA, 465 bp, Artificial Sequence
  Description of Artificial Sequence: Synthetic polynucleotide
ggtccaggatacggttatgcagcctattacgcaagttcatatggttacggacctggagttggatctggagcgggagctggatccggttcaggcgctggcagtgcagccggtgccggcagtggtagcggagccggcgcaggtcgagacgtgaccaatactgttgttaactctgtctctagattgtcgtccccttctagttccagcagagtttcatccgcagtttccggattgttaccaaacggaaacttcaacttgggtaacttaccaggtattgtttctaacttgtcctcctctattgcgtcctcaggtttatctggttgcgaaaatcttgtacaagttcttatcgaggtcgtcagcgcactggttcacattctaggttcggctaacatcggtaatattaatatgaatgctgcttccagtactgcagccgccgtaggccaagccattgtcaatggattgtattca

SEQ ID NO: 57 - DNA, 708 bp, Artificial Sequence
  Description of Artificial Sequence: Synthetic polynucleotide
ggtaaagcgatttcctcttctgcagcatccgcagctgcatctgcgtcggctgcttcagctgccgctacagcctcggctgcagcaagctcaagcgcttcaactacaagaacaactggagcaacgtcggcagccggtgatttctcagttgtggccgacgccagcgcagattcctcagtcttagctgatgaagctgctagaggagccgtcggtgccgtgtccggaggcggagccgcctcccgctcggtaggtttgattggatctggtttcccgggatatgtttcttctgctccattctcactcatttcttcagtggcaggtggtggtggaagttctccagtgcctgtctcaccactcgccggaggtttgctaccaccatcaagttatctgtcctccccagcagccgctgagagaattagttcagtgattccacttctattatcaggtattagtccaaatagattagatgcctcgttgcttggcaacactctgggtagcttggtcgcacaagtttctttgaatcgtgcaggattgtcattttcacaaatcattgtagaagcactattggaattgttgtgtggcgttatccagatcttaagtttcgccgaaattactgtagttaacacaggtacattatcgtcaaccagttttgccttggctcaagctatgtctgccgctgtgagaaatacctaccgtttccactcaactgta

SEQ ID NO: 58 - DNA, 486 bp, Artificial Sequence
  Description of Artificial Sequence: Synthetic polynucleotide
ggtggatacggaccaggcagcggacagcaaggacctggtcaacaaggtccaggtcaacagggccctggtcagcaaggtccctacggagccggtgcttcagctgctgcagccgcagctggaggatacggtccaggtagcggacaacagggtccaggtgtgagagtagcagcccctgtggctagtgccgctgcttcccgtctcagttctagcgccgcatcttcaagggtttcttcggcagtctcttcacttgtttcttcaggaccaacaactccagctgctttatccaatacaatatcttcagctgttagccagatttctgcatcaaatcctggactaagcggttgtgacgtgttggttcaagctttgttagaggtcgtttctgctttggttcatatccttggatcttcaagtgtcggtcaaatcaattacggagcatcagcacagtatgcacagatggtgggtcagagcgtaacacaagccttggta

SEQ ID NO: 59 - DNA, 423 bp, Artificial Sequence
  Description of Artificial Sequence: Synthetic polynucleotide
ggtggagccggaggtgctggtcaaggtggtttaggcgctggtggagctggacagggcggttacggcggaggagcctatggaggtcaaggagcagcttcctctgctgctgcagcctctgcagccgctagccgtctctcttcgccttctgccgcaagtagagtctcaagtgcggtttcttcattagttagctccggcggaccaagttcaccagctgccctgtcctcgactatctctaatgtagtctctcagatttcagcttccaatccaggattgtcaggctgtgatgtactagttcaagcattgctggagattgtctcagctctagtccacattctgggaagtgctaacattggtcaagtaaactcgtccgctgcaggacaaagtgcgagtctagtcggacaatctgtctaccaggccctgtca

SEQ ID NO: 60 - DNA, 459 bp, Artificial Sequence
  Description of Artificial Sequence: Synthetic polynucleotide
ggtggttatggaccgggagcaggtcagcaaggaccaggaggtgcgggacaacaaggcccgggaggtcaaggaccttatggaccatctgttgccgcggccgcgtccgctgccggcggatatggacctggtgcaggtcaacaaggtccagtagcatctgctgcagtctctaggttatcttcgccacaagcttcttcgagagtttcctcggctgtttcaagtctagtctcttcaggtccaacaaatcctgctgctttgtctaatgctatgtcctcagttgtctcacaagtttcggcctctaatcctggcttgagtggttgtgacgtactcgtacaagcactattagaaattgtgagtgccctggtccacattctgggttcatcttctataggccaaataaactatgctgcttcttcccaatacgcccaaatggtcggtcaatctgtggctcaagcattggca

SEQ ID NO: 61 - DNA, 498 bp, Artificial Sequence
  Description of Artificial Sequence: Synthetic polynucleotide
ggtggctacggaccaggagccggtcaacaaggcccaggaggtgctggacagcaaggtcctggttcccagggtccaggtggcgctggccagcagggtcctggtggacaaggaccatatggtccctctgcagcagccgccgcaagtgccgccggaggatatggtccaggtgctggtcagcaaggccctgtcgcctcagcagctgcatctagactttcatcccctcaagcatcaagtcgtatttcatcggccgtctcttcactggtttcttcaggtccaactaatcctgctgctctttctaatgccatctctagcatcgtatcgcaggtatcagcttcgaatccaggattatcaggttgtgatgctttagtacaggctttgttagaaatcgtatctgctcttgtacatatcctaggttcttcaagcataggtcaaataaactatgctgcttcaagtcagtacgctcaaatggtcggtcaatctgttacacaagctctagta

SEQ ID NO: 62 - DNA, 447 bp, Artificial Sequence
  Description of Artificial Sequence: Synthetic polynucleotide
ggtggatacggaccaagatatggtcagcaaggtccaggagctggtccatatggaccaggtgctggagctaccgcggctgcagcaggtggttacggaccgggagctggacaacagggtcctagatctcaagcaccagtcgcctcagcagctgctgctcgtttaagctcgccacaggcaggtagtagggttagcagtgccgttagtactttagtctcttctggacctaccaatccggctagtttgtcaaacgctatcggttcagttgtatctcaggtcagtgctagtaacccaggattaccaagttgtgatgttttggtgcaagctctcttggaaattgtttctgctttggtacacatcttgggcagcagctcaataggacaaattaactactctgctagttcccaatacgcgaggttggtcggtcagtccattgcccaagccttggga

SEQ ID NO: 63 - DNA, 420 bp, Artificial Sequence
  Description of Artificial Sequence: Synthetic polynucleotide
ggtggtcaaggaggctatggaggtttgggaagtcaaggtgctggacagggcggatacggtggcggtgcttatggaggccagcaaggtgcagctgcctccgccgcagctgcatcagccgctgccagtagattgtcgtcccctggagccgctagccgagtctcatctgcagtgacttcattggtatcatcaggaggtccaacgaactcagctgctttgtccaacactatatccgacgttgtttcccagatatcagctagtaatccaggattatccggctgtgacgtgttagtccaagcacttttggagatcgtttcagctctggttcacattctgggaagtgcaaatataggtcaagtcaactccagttccgccggtcaatctgccagcttagtgggtcagtctgtataccaagcattatca

SEQ ID NO: 64 - DNA, 363 bp, Artificial Sequence
  Description of Artificial Sequence: Synthetic polynucleotide
ggtggttacggaccaggtgcaggtcaacaaggacctggatcacaagctcccgttgcatcggcagcggcttccagattatcttcaccgcaagcttctagtagagtttcttcggccgttagtacattggtgtccagtggtcccaccaacccagctgccctgtctaatgcaatctcttctgtcgtgtctcaagtttcagcctctaacccaggactctcaggctgtgacgttttagtccaagctctacttgagctcgtcagtgccttggtgcatatcctgggaagtagttctataggacaaataaattatgccgccagcagccaatacgctcagatggttggaaactcagttgctcaggcattggga

SEQ ID NO: 65 - DNA, 489 bp, Artificial Sequence
  Description of Artificial Sequence: Synthetic polynucleotide
ggtggatatggaccaggtgctggtcaacaaggtcctggtagccaaggtccaggctccggtggccagcaaggacctggtggtcaaggaccatatggtccatcagccgccgccgcagcagctgctgccggtggatacggtccaggagcaggacagcaaggtccatcttcacaagccccagtagcttcagctgcagccagtcgattgtctagtccacaggcctctgctagagtaagtagcgctgtaagtaccctcgtgtctagcggtccaacatcccctgccgctctctctaatgccatttcttctgttgtctctcaagtctcagcaagcaatcctggtcttagtggttgtgatgttttagttcaggctctcctggaaattgtgtctgctttggtgcacatattgggtagttcgtccataggtcagataaactacgcagctagtagtcaatacgctcaaatggttggtaactccgttgcgcaagccttagga

SEQ ID NO: 66 - DNA, 513 bp, Artificial Sequence
  Description of Artificial Sequence: Synthetic polynucleotide
ggtggccaaggaggtagaggtggatttggaggtttgtcctcacaaggcgctggaggtgctggtcaaggaggatctggtgccgctgcagccgctgccgccgccggtggagatggtggatctggattaggtgattatggagccggcagaggttacggtgccggcctcggtggagcaggtggtgcaggcgtggccagtgcagctgcttctgctgccgccagtagactgtcatccccaagtgcagctagcagagtcagttctgctgtcacttctttgatatctggtggaggccctactaatccagctgctttatccaacactttcagcaacgtcgtttaccaaatctctgtgtctagtcctggattaagtggttgcgacgttttaatacaggctctactggaacttgtatccgctttggttcatattctcggttcggcaatcattggacaagttaattcctctgcagctggtgaatctgcgagccttgtcggtcaaagtgtataccaggctttttca

SEQ ID NO: 67 - DNA, 531 bp, Artificial Sequence
  Description of Artificial Sequence: Synthetic polynucleotide
ggtggacagggaggccaaggtggctatggcggcttaggatcccagggagccggacagggtggttacggccagggtggagccgctgccgcggctgcgtccgccggaggtcagggtggccaaggtggttacggtggattaggctcccaaggtgctggacaaggtggatacggcggtggagcattttccggtcaacaaggtggtgcagcttctgttgctacggcatctgccgctgcatccagactttcctctcctggagccgcctccagagtcagttctgcagttactagtcttgtttcaagtggaggcccaacaaactctgccgcattatccaatacaattagcaacgttgtaagccaaatttcctcaagcaatccgggtctgtctggatgcgacgtactcgtccaagcacttttggaaattgtctctgcactggtgcacattctaggctccgccaatattggtcaagttaacagttccggagttggtaggtcagcatccattgtgggacaatcgattaatcaagccttttca

SEQ ID NO: 68 - DNA, 366 bp, Artificial Sequence
  Description of Artificial Sequence: Synthetic polynucleotide
ggtccaggatatggaccaggcgcaggacaacagggcccaggatctcaagcacctgttgcttctgccgctgccagtaggttatcgagcccacaggcttcatccagagtgtctagtgccgtttctacacttgtctcatcgggtcctacaaatccagcatctctctctaacgcaatttccagcgttgtgagtcaagtctcttctagcaatcctggattgagtggttgcgacgtcttagtgcaagcacttcttgaaatcgtctcagcattggtgcatattctgggttccagttcaatcggtcaaataaactatgctgcttcctcccagtatgcacagttggttggccaatcccttactcaagctttggga

SEQ ID NO: 69 - DNA, 660 bp, Artificial Sequence
  Description of Artificial Sequence: Synthetic polynucleotide
ggtgccgcttctagtgctgctgtgggcgcagctgctacctcgggtgccgccacctctggagctgcaactagcagttcaagtgcgactggcgttggtggatccgtttcttccggagcatctccagcctctgcaggaaccgcaactggaggaggaatttctttcctacctgttcaaactcaaagaggcttcggactagtcccgtcgccaagtggtaacattggagccaatttcccaggatcaggtgaattcggcccttccccattgacttcaccagtttacggaccaggtatcttgggaccaggactggttgttccatcattgcaaggtttgctaccaccattgtttgttttgccttcaaattcagctacggagcgaattagtagtatggtatcaagccttttgtcagcagtctcttctaacggactggatgccagctcctttggtgacactattgcttctttggtttcccagatatccgtcaataactctgatttgtcctcgagtcaggttttgttggaggcactactggaaatattatcaggtatggttcaaatactttcgtacgccgaagtgggaaccgtgaatactaagactgtatccagtaccagcgcagcggtggcccaggctatttccagcgctttttccggaaatcaaaattca

SEQ ID NO: 70 - DNA, 549 bp, Artificial Sequence
  Description of Artificial Sequence: Synthetic polynucleotide
ggttctggcgcagcaagagctgctcagacagcttccgctgcaagtgcagcctctgccagctcaagcttggctcagttgggaagtgccctagcacaatcttcttctttcgctgcagctttcgaccagggtaattccgccgctagtgccgctgctatagcttacgtccttgctcagagtgccgcaaacaaggtgggtttgagttcttatagtgcggctataagcaatgctgcctccgctgcagtcgaatctgttggtggttatgcatccgctagcgctcatgcttttgctttcgcttcggccgtttcacaggttctgtctaactatggattgataaacttgtctaatgctttgtccttggcaagttccatagctaacgctgttagcgcttctgctagttcagctgcagccgtgtctagtgctgcagcagctacaggtgctacctctagtgcagcagtcggagcagccgctacctgtggtgctgcaacatctgcatcaagtgccacgggagttggagaaacagtagcatgtgcaactagcccagcctcaaca

SEQ ID NO: 71 - DNA, 555 bp, Artificial Sequence
  Description of Artificial Sequence: Synthetic polynucleotide
ggtactgcagctggtggtggaatttctagcttacctgtacaaactcagcctggattcggtttcttgttgtctccttctggaaacattggcccatccgttagcggcagcggtggttttggaccttccccattaccatctcctgcctctgatggctttagtccgtccccactcccatcccaagtttatggaccaggaatattgggacctggtttagtagccccttcgctcgaaggtctgttgccaccactgagtatcctaccttctgattcagctaatgagcgtatcagctccgttgtcagttctctcttggctgctgtatctagcaacggtttggatgcaagttcactaggtgataatctcgcaagcttggtttcccagatcagtgctaacaatgctgacctgtccagtagccaagttatggtggaggccttgttggaagtcctaagcggtatagttcagatcttgagctatgccgaagttggtgccgtgaatacagaaaccgtttcgtcaacaagttccgcagttgcccaggcaatatcatctgctgttttagga

SEQ ID NO: 72 - DNA, 528 bp, Artificial Sequence
  Description of Artificial Sequence: Synthetic polynucleotide
ggtagtggaggatatggttcacaaggagcaggccaaggaggccaacagggtcgtggtcaaggtggtcaaggtcaatatggcccaggagagggcgagcaggttccaggccaaggaggtcaaggtccagcagcttctgccgctactgcttcagcaggaggacccggtgaatacggaggtcagcaaggccctggacaaggtggacaacaacaaccaggtcaaggcggacaaggcccatctgctgctgccgctgcctctgctgctgtaggtagcggaggatacggttctcaaggtcaacagggacaaggaggacagggacctactgcttccgcagctgctgctgcagcttctgttgctggtccaggtggttacggcgcttccggacaacagggtcctcgtcaaggatcgcaacaaggaagattcggaccagcagctggacaacaaggaccaggacagacgggacaaatgggcccaggtcagcaaggtccaagcggaccgtcatcggctgccgccgcttccgctgcagccgca

SEQ ID NO: 73 - DNA, 429 bp, Artificial Sequence
  Description of Artificial Sequence: Synthetic polynucleotide
ggtggtccgggcggatacggtggtccaggtcaacaaggtggtggccaacaagccccggtccaaccgcgaccatacgttccaggaatgtcaggtcagatagtgacatcagacgtttcatcaaccgtatccagcgccgtttctagaatgtctactccaggctctggttcgagaatttctaatgcagtgtctaatattcttagttccggagtatcgtcaagtagtggcttaagtaatgtcatcagtaatttgtcctcttcaatttccacatccaatcctggactatctggttgcgacgttctggtacaagttttactggaagttataagtgctctagtacacatcctgagttccgcttctttaggtcaagtgggatcttctccacagaatgcacagatggtcgctgccaacgctgtggcgaacgcattttca

SEQ ID NO: 74 - DNA, 426 bp, Artificial Sequence
  Description of Artificial Sequence: Synthetic polynucleotide
ggtccaggaggctatggaggtcctggtcagcagggtggtggacaacaagcaccagtacagccaagaccatatgttcctgttacaagtggtcaaattgtgacaagtgacgtaagttccacagtttcatcggccgtttccagaatgtcaacccctggatccggatctagaattagcaacgccgtctccaacattttgtcctcaggagtctcatccagttccggattatccaacgctattagtaacattagttccagtatctcggcatctaatcctggactatcgggatgtgatgttcttgttcaagttcttttagaggtaatttcagcactggtacatatattgggctcagcatcagttggtcaggtgggttcatctccacaaaatgcacagatggtcgcagcaaacgctgttgccaatgctttctca

SEQ ID NO: 75 - DNA, 594 bp, Artificial Sequence
  Description of Artificial Sequence: Synthetic polynucleotide
ggtgctggtggtgactctggcctattcttatctagtggagactttggccgcggcggtgcaggagccggagctggtgctgcagccgcttcagctgcagcagctagtgctgcatcggccggtgccggcagaggtacaggttttggagaaagaatactaataggcggttcaagaggattcggtggcgccagggttgatgctcctgcagcatcaactgcttctgcaagtgctgcggctgcgtcctctggcgctggtggcggctctaggtttggtggattaggagtgggagtatttggtgccggatcgggtgaactgagtgttgcttcacgcataagcactatggcttcttctatgtcatcactgttatcctcgaatttctcaccagttattttttcctctcttgctaacgtaattgcaaatggtgcttctgctatagcagtcgctcatccagaattatctggtgcaggcgtgttaacagaagcattactggaagcattggtggccttctgctacgcacatgcgggatcaatcgcctccgcttctgatgtcaacttagcagtgacaacactcgcatctaccatgcaaggttccctgcca

SEQ ID NO: 76 - DNA, 411 bp, Artificial Sequence
  Description of Artificial Sequence: Synthetic polynucleotide
ggttctggacagggtgcgtctttcggaatatcccaacaatttggagctcctagtggagctgcttcctccgcagctgcagctgccgctgccgcggccggagctagctccccaggtgccttgctggtttctgccgatgcaccatccagaatagctagtgtgtcatcatctttaaactccgtcgtctcttctggcgcttctgcatcttctttcgcctccattgcgacccaaatcgctgatgttgcaggtcaagtgtctagtgttcaccctgagctctcatccttggaagtactcgtagaagctctgatcgaaatcattgttgcactagtgcacgcacagtcaggaggagcgtcaagtgcaagtgcgtccgcttcagcatcagctctggccagccaactaggacagcttttcgga

SEQ ID NO: 77 - DNA, 504 bp, Artificial Sequence
  Description of Artificial Sequence: Synthetic polynucleotide
ggtggagctggagccggtcagggtggttacggaggacaaggaggattgggtggttatggacaaggagcgggtgcaggagcaagcgctgcggcttctgcttccggtgctggtagtggtcaaggaggatatggaggacagggtggatacggtcagggaacaggtgcaggtgctgcttcaagcgctggtgtcgcagtaactgttggaaacactgtctctagactatcatccccacaagcggcttctcgtgtttcctcagctgtttcatccttagtatccaacggacaagtcaatgtcgcagcattaccaagtataatttcctctctgtcgtccagcatatctgcttcgtcgactgccgcaagtgactgcgaagtgctggtgcaagttttgctggagattgtctccgctcttgttcagattgtctcaagtgccaatgtcggttacataaatcctgaggcatctggatctctcaacgcagtcggctccgccttagctgctgctatggga

SEQ ID NO: 78 - DNA, 495 bp, Artificial Sequence
  Description of Artificial Sequence: Synthetic polynucleotide
ggtcagggcggtcagggaggttacggacgacagtctcaaggagccggatcggctgcggctgccgcggcagccgcagcagcagctgccgctgcaggaagcggtcaaggcggatatggtggccagggacaaggaggatatggtcaatcttccgcttctgcctcagcagcagcctcggcagcctcgaccgtagccaattcagtctctaggctgtctagcccatcggccgtctccagggtttctagtgctgttagctctttggtatcaaacggccaagttaacatggcggctttacctaacattatatctaatattagctcatctgtctctgcttccgctccgggtgcttcaggctgtgaagtgattgtacaggctttacttgaagtaattactgcactagttcaaattgtctcatcgagttcagttggatatattaacccatcagcagtgaatcagattaccaatgtcgtggctaatgctatggcacaggtcatggga

SEQ ID NO: 79 - DNA, 504 bp, Artificial Sequence
  Description of Artificial Sequence: Synthetic polynucleotide
ggtggtcagggacaaggtggatttggtcagggaaccgttggaaatgccgctgccgcagctgccgctgctgctgcggccgcagccgctcaacaaggaggacagggcggtttcggtggccaaggccagagaggattcggacaacgtgcagcttctgcagtcgcctctgccgcatcggctgcagacgtcggcaataccgtagctaacaccgtttcccgattgagctcaccatctgctgctagtagagtaagttcagcagtggctaacttggtcagtaacggccaactaaatatggccgctttgccatatataataagtaatattagtagttccgtatctgcaagcgttcctggtgcgtcaggttgtgaggtcatcgttcaagctttattggaagtcgtagcagctttatgccaaatcgtttcatcctccaacgttggatacattaatccgtcggccgtgaatgacatcacgaacgttgttgccaacgctatggctcaagttatggga

SEQ ID NO: 80 - DNA, 504 bp, Artificial Sequence
  Description of Artificial Sequence: Synthetic polynucleotide
ggtgagagcggacaaggaggttatggaggtcgtggtcaaggaggatacggacagggagcaggcgcagccgctgctgctgccgtcgctgctgcagccgcagctgccggacaaggtggatttggaggtcttggcggttatggtcaaggtgccggttcagcaaccgctgccgccagctccgctgacgtctccacaactgtcgctaatagtgtatcaagactgagtagtgcttctgcagctagcagagtctactctgttgtatcaaatctggtttcaaacggtcaagtgaacattgctgcgttaccgaacattatctcaaacgtgagtagttcagtttctgcgtcagcaccaggtgcttctggatgtgaagttattgttcaagttttattggaaattgttgctgccctgacttctattgtctcttctgctagtgttggatatatcaatcaatacgctgtaaatgatataaccaacttggttgctaacgcaatggcaggcgttatcgga

SEQ ID NO: 81 - DNA, 342 bp, Artificial Sequence
  Description of Artificial Sequence: Synthetic polynucleotide
ggtggctacggtccaggtagcggtggttctccggcctctggagcagcatcccgcttgtcaagtccacaggctggtgcacgtgtttcatctgctgtgagtgctttagttgcgtccggaccgacatcacctgctgcggtaagttctgctatctccaatgtcgcctcccaaatatctgctagtaaccctggactttcaggttgcgacgtactggttcaagctctgcttgaaattgttagtgccctcgtctccatattgtccagtgcttcgatcggacaaattaattatggagcttcaggacaatacgctgctatgataggccagagtgttgcacaagcattagca

SEQ ID NO: 82 - DNA, 531 bp, Artificial Sequence
  Description of Artificial Sequence: Synthetic polynucleotide
ggtgcttctggagctggtcagggtcaaggctacggacagcaagcacaagtctacaaccaaggtggctccggttctgttgctaccaccgctgccgctgcttcgggtgctgtaggagtgtcgcaaaactatgcgcaggctcccgtttactacggaggttcgagctccagttattcctcgtcaatcactagttactcatccagtgtgttgcctattgctattttgcagtcaccagctggtctaacctcatctgcagctggaagcagaatgtcaagcgtcgcgacctccattacttcacttatcccgagtaacggtagtccattcaactatagcgctttctccaatactttggccagtctgattaacaacattggtaattctaatcctggcttgtccagaaacgatgtgaccatcgaagctttactggaggtcatcactgccctgctacaggtgatctccaacggagaattgtcggctgctgctagctcttacgccgccgcaagcctacttcaaagcatccaacaaggttattca

SEQ ID NO: 83 - DNA, 603 bp, Artificial Sequence
  Description of Artificial Sequence: Synthetic polynucleotide
ggtgcttacggtttcacccaagctgccgcatctgccgttgcttccgttttactgcaagctggtgtcctaaattatggaaacgctactgcactggcatctgcatatgcaagcgcttatgcttcatctgtggcgtccgctgcagcttctgcatcagccggtgcttctgcttcctcgggagcatcagcttacgcatctgctgttgcagcagctgcggctgccgcctctgttagcacctcagcaggcgctagtgcttccgctggagctagtggtctttccttctctcaagctcaagcaagtgccttgtctagttctgctgctgcttacagaattagttctttaattacttcatttgtgtctggtttgtcagcaggtggtggttcagtaaactactcagtgattgccaatgctcttgccagcgtcgcctcacaaatcagtgctagcaacgccggtctgtcagtttcacaagtagcagtccaagctttattagaattctcaactgcgttgattcaaatcttggcatcatcacagattggatacgtaaacactgcatccgctggatctacagcctctgcattttcacaagcactggcacagaccttcgca

SEQ ID NO: 84 - DNA, 498 bp, Artificial Sequence
  Description of Artificial Sequence: Synthetic polynucleotide
ggtggagccggtcagggtggttatggcggactgggaggtcaaggcgcgggacaaggaggattaggaggacaaagagctggtgccgcggctgctgcggccggcggtgctggtcaaggtggctatggaggactaggatcgcaaggtgctggaagaggtggttacggaggcgtcggttccggtgcctccgctgctagcgcagccgcatctcgcttatctagtcctgaagcttcatcgagagttagcagcgctgtatccaacctagtttcctcaggtccaaccaattctgctgccctttcatctaccatctctaacgtcgtatcgcaaattagtgcctcgaatccaggattatccggttgtgatgtgcttgttcaggctttattagaggttgttagtgccctgattcaaatcttgggttcttcatcaattggccaggttaactacggaactgctggccaagctgctcagattgttggccaaagcgtttatcaggcattagga

SEQ ID NO: 85 - DNA, 453 bp, Artificial Sequence
  Description of Artificial Sequence: Synthetic polynucleotide
ggtggagcaggtcaaggaggttatggcggattaggtggacagggagtgggaagaggcggacttggaggacaaggagccggtgccgccgctgcaggcggagcaggccagggtggttatggtggtgtcggcagcggcgcaagtgccgcttccgctgccgcgtctcgcttgagctcacctcaagcttcaagtcgtctatctagtgcagtctcaaaccttgtagctactggacctactaactcagctgcgctgtcgtctacaataagcaacgtcgtatcacaaataggtgcttctaacccaggtctgagtggatgtgacgtattaatacaagccctcttagaggtagtttcagccctaattcaaattttgggaagcagttcaataggacaagtgaattacggttcagctggacaagctacacaaattgtcggtcaatccgtgtaccaggccttagga

SEQ ID NO: 86 - DNA, 492 bp, Artificial Sequence
  Description of Artificial Sequence: Synthetic polynucleotide
ggtccgggaggttacggacctgctcaacaaggcccttcaggtcctggaattgctgcctctgcagcaagcgccggtccaggtggatacggtcctgcacagcaaggaccagctggatatggccctggtagtgctgtcgctgcctccgcgggagccggttctgccggctacggaccaggaagccaagcaagcgctgcggcgagtagactggcctcaccagattccggagcccgtgtcgcttcggccgtgtctaatttggtttccagtggaccaacctcttcggctgccctatcatccgtaataagcaatgcggtttcacaaatcggagcatctaatccaggtttatctggatgtgatgttttgattcaggccttacttgaaattgtatctgcgtgtgttacaatattgtcctcttcgtctataggtcaagttaattacggagctgcttcacagtttgctcaggtcgttggacagtccgttttgtcagcattttca

SEQ ID NO: 87 - DNA, 477 bp, Artificial Sequence
  Description of Artificial Sequence: Synthetic polynucleotide
ggtcctggtggatatggaccagttcaacagggaccttcaggtccaggatccgccgcaggcccaggaggttacggtccagcccagcaaggaccagcacgctatggtcctggatccgcagctgcggccgcagcagctgccggatctgctggatacggcccaggtccacaggctagtgctgccgcttcgagactcgcaagtccagatagcggtgccagagttgcctctgccgtttctaacctggtatcttccggtcctacatcttctgctgcgctttctagtgtgatttcaaacgcagtcagtcagatcggagcttcaaaccctggattaagcggttgtgatgttctgattcaagcccttttggagatcgtttcagcatgcgttaccattttgtcctcctcgagcataggtcaggttaattacggagctgcatcacaatttgcacaggtcgttggacaatctgttttgtctgctttttca

SEQ ID NO: 88 - DNA, 459 bp, Artificial Sequence
  Description of Artificial Sequence: Synthetic polynucleotide
ggtggagctggtcaaggtggctacggtggattgggatctcaaggtgctggaagaggaggttatggcggtcaaggagcaggagcagcagccgctgccacaggcggtgctggccagggaggatacggaggtgtcggctcaggagcatctgccgcatcagctgctgcatcccgactttcatctcctcaagcatcgtcgagagtatcgagtgcagtatcaaatcttgttgcctctggacctactaattctgccgctttgtcgtccactattagtaacgctgtttcgcaaattggtgccagtaacccaggtctttcaggttgtgatgtactgatacaagctttattggaggttgtttctgctttgattcatattttgggtagttcttccattggccaagtaaactacggatcagccggtcaagcaacccaaatagtaggacaatctgtttatcaagccttggga

SEQ ID NO: 89 - DNA, 492 bp, Artificial Sequence
  Description of Artificial Sequence: Synthetic polynucleotide
ggtggagcaggacagggaggttatggaggcttgggaggccaaggatccggtgccgccgccgctggtactggacagggtggatacggcagtctgggtggtcaaggagctggcgcagccggagctgctgcagcagcagttggtggtgccggtcaaggcggatatggcggtgtaggatccgctgctgcctcagctgccgcttcccgtttgtcatcaccagaagcctcatcccgtgtttcgagcgccgtctcaaacttggttagttctggacctacaaattctgctgccttgagcaacaccatcagcaacgtagtgtctcaaatttcatctagcaatcctggactaagcggatgcgacgtcctcgttcaagcactcctggaggttgtgtctgccctcatccacattctgggctcttctagtattggtcaagtgaactatggttcagcaggccaagcgacacagatagtcggtcaatcagtatatcaagctttggga

SEQ ID NO: 90 - DNA, 459 bp, Artificial Sequence
  Description of Artificial Sequence: Synthetic polynucleotide
ggtggagctggccaaggtggatacggtggcctcggttctcaaggcgcaggtagaggaggttatggtggtcaaggagctggagctgcggttgcagccattggaggtgtcggtcaaggcggttacggaggtgtaggatctggtgcttccgctgcttcagccgctgcaagcagactttcttctcctgaagcatcaagtagagtatcttctgctgtttccaatctagtctctagtggtcctactaactctgctgctttaagctctacaatctcgaatgttgtatcccagattggtgcatcaaatcctggtttaagcggttgcgacgtgttgattcaagctctgctggaagtagtctcagccttggttcatatcttaggcagctcttcaattggacaagttaactacggatccgcaggtcaagctacccaaattgttggccagtctgtttatcaagcactggga

SEQ ID NO: 91 - DNA, 426 bp, Artificial Sequence
  Description of Artificial Sequence: Synthetic polynucleotide
ggtggttccggaagaggtggatacggctcacagggtgcaggacaaggagctgcagctgctgcggccggaggtgccggtcaaggaggatacggtggtgcaggttctggagccgctgcagcctctgcagccgcgtctagattgtccagtcctgaagctagctctcgagtctcaagtgcagttagtaacctagtttcttcaggaccgactaactcagctgcgctgtcaaatacaatttcttccgttgttagccaaatatccgcttcaaaccctggtcttagcggatgcgacgtgttggtacaagccctccttgaagtcgtttctgcccttatacacattttgggatcttcatccatcggtcctgttaactacggttctgcgagtcaatccacgcagatagtcggacaatccgtttaccaagcattagga

SEQ ID NO: 92 - DNA, 498 bp, Artificial Sequence
  Description of Artificial Sequence: Synthetic polynucleotide
ggtggctatggaccaggatcaggacaacaaggtcccggtggcgccggtcagcagggccctggaggtcagggaccttatggtcctggaagttcttccgctgcagccgtgggaggatacggaccatccagcggcttgcagggacctgctggtcaaggtccatatggacctggagctgcagcctcagcagctgccgctgctggtgcatctcgtctgtcgagcccgcaagctagttccagagtgagttccgcagtttcaagccttgtctcatccggtccaactaatagtgctgctctgactaacactatttcgagtgtagttagccaaatttcagctagtaacccaggtctatccggttgtgacgtcttaattcaagcactgctcgaaattgtatctgccctagtacacatactaggctacagctccattggacaaatcaattatgacgctgctgcgcagtatgcttctctagtcggtcaatctgttgcacaagccctcgca

SEQ ID NO: 93 - DNA, 537 bp, Artificial Sequence
  Description of Artificial Sequence: Synthetic polynucleotide
ggtgttttgggaggtcaaggaggattgggtggcttgggatcgcaaggtgctggtcagggaggatacggtcaaggaggtgccggacaaggaggtgctgccgcagccgctgctgcagctgcagcaggaggactcggaggacaaggtggtcgaggaggacttggttcacagggtgcaggccagggaggttacggccagggtggtgctggtgcatcttccgcagcagctgcctcggctgctgcatctagattatcttccgcttctgctgcttctagagtttccagcgccgtctcatctttggtatcatccggtggtccaacgaactcagcggcattatcctcaacaatttcaaacgttgtctcccaggtttcagcgtccaatccaggcctttcaggttgtgatgtattggtacaggccttattagaaatcgtctcagctttagttcatattcttggaagttcatctataggacaagttaactataatgcagccggacaatccgcatccgttgtgggacagtcattttatcaagcattggca

SEQ ID NO: 94 - DNA, 690 bp, Artificial Sequence
  Description of Artificial Sequence: Synthetic polynucleotide
ggtactggtcagggcggagtcggtggttacggtcagggtgccggttcgtccgctggtgccggaactggtggtgtcggtcaaggcggatacggatcttatggaagttcctaccaatcaacgagcggtatctctatcgcactctctacacaatcattaggtggacaaggtcagtacggccaaggtttgggagccggagcttccgcaggtgctggagctgccgttggtactggtctaggtcagggaggtctaggtggatacggacagggatccggtagtgcttccgccgctgcgtcgggttcaggttctgccattggtggatttggtggctatggtcaaggagctggcctaggagctggaaccgcagccgacgtaggcgctacggtaagtaatactgtttctagactgtcctccccagctgctaccagcagagtttcatcagcggtcagttcgcttgttgctaatggtgcacctaatttatcatctttaccaaatgtaatcagtagtttatccaactcagtgtccgctagtaccccaggcgcttctggatgtgaaatactggtgcaagtcctgatggaggtcgtcaccgcattggtacagatattatctagtgcaaacgtatcaagcgtgaacgccggtgacccatctcaagccgctatgactgttggtcaatctgtggcagccgctcttgga

SEQ ID NO: 95 - DNA, 624 bp, Artificial Sequence
  Description of Artificial Sequence: Synthetic polynucleotide
ggtgcttcttccaacgcaagttctgctgccgctgcagcttctacagttctagctggcgttgcaccagctggatcatccgcttctagttcagctgcctcagcatcaactggtgccggcgctgctatttcttccgtaggaccagccgttggattcggcgccggtcctgccccagcaggaggtttggtttcaggactaccaggctattcaccactgaatcagggctttacgccatacccgggagtacctttgccaactggatcaggtgtctcagcaccagtgcctgtatctcctctaccactcggtttgttaccttcatcgttggacttgtcatcacctagtgctaccggacgtatgtcatccctcgtacgttcattgctgagtgccgtcagttctggaggattgaactcgagtctcttgggatcaaccctgacttctctggtgtcgcaaatttcctcaagcaggtcggatttgtcggcatctcaagtcctggtggaggccgtgcttgaaatcctatccgctgtaatccaaattctatcaagtgctacaattggtgttgtatctaccgactctgtcggtgctacttcaagtgccgtggcacaagcagtttcttcggcgtttgccgga

SEQ ID NO: 96 - DNA, 426 bp, Artificial Sequence
  Description of Artificial Sequence: Synthetic polynucleotide
ggtggtttgggtggtggacaaggtggatatggatccggactaggaggagttggtcaaggaggccaaggtgcattaggtggtagccgtaacagtgcaactaacgctatatctaattccgctagtaacgcagtatcactactttcatctcctgcatctaatgctagaatctcctccgccgtatctgcattggcgagtggcgccgcctcaggtcctggttacttgagctccgttatctccaacgttgtttcgcaagtttcctcaaatagcggaggcttagtaggatgtgatactttggtccaggcactactcgaagctgcagctgctcttgttcacgttttggcttcttctagtggaggtcaagtaaatctcaatactgccggttatacttcacaaatggtgtcccagaccattgctcaagtctttgca

SEQ ID NO: 97 - DNA, 414 bp, Artificial Sequence
  Description of Artificial Sequence: Synthetic polynucleotide
ggtggcctcggaggtggccaaggaggccaacagggcgctggtagaggtggtctgcaaggtgccggtcagggtggacagggtgccttaggaggatcaagaaactccgctgccaatgcggtttcgagacttagctcgccagcctctaatgccagaatctccagcgctgttagcgctttggcatcaggaggtgcaagctcacctggttatctgtcatcaataatttccaatgtcgtctcccaagtgtcctccaataatgatggtctttccggttgtgataccgtcgtccaggcattgttagaagtcgccgccgcacttgtccacgtcctagcttcaagcaatataggccaagttaatttgaatactgcaggatatacctcgcaaatggtttcgcagaccattgctcaagtgttcgca

SEQ ID NO: 98 - DNA, 411 bp, Artificial Sequence
  Description of Artificial Sequence: Synthetic polynucleotide
ggtggaagcggcggtcaaggtggacagggcggttacggatctggaggacaaggtcaaggacagggtggatatggtagcggtgcggcttctgctgccgcggcagcatcctcatccgtcagccgtctccaatcccctgcttccagctcaagagttagttcggccgtatctactttggcctcagcaggagctgctaactcgggagctttgtccagcgtcatttctaatctgagctcttctgttgccagtgctcaccctgacttgtctggatgcgaattacttgtgcaaattcttcttgaggtgatcagtgccctagtcgcattacttggctcatcaacagtgggacctgtcgatattggtcaaagcagtcagtactctggtctggtcgcaaacgctataggtaatgctctcgca

SEQ ID NO: 99 - DNA, 399 bp, Artificial Sequence
  Description of Artificial Sequence: Synthetic polynucleotide
ggtcctggtcaacaaggtccttatggaccatcccaacagggtccaggtagctacggtccatccggtcaagtttcatccgttagtgcctcagtttcttccgccgctagtagattgtcaagtccagctgcttcctctagagtctcatctactgtctctagcttggcctcatcgggaccgtctgacgccagtgtggtttcaagcgcattaagtaacttagtcagtcaagtatcagctagtcaaccaggtctgtccggatgcgacgtcatcgtgcaggctttgctggaactcgtttccgctttagtccacatcttgggtagttcttctctcggacaagttgactacaacggcgcatcttacagtgctcagaggctgtcccaagcattaggaaacactcttgga

SEQ ID NO: 100 - DNA, 408 bp, Artificial Sequence
  Description of Artificial Sequence: Synthetic polynucleotide
ggttccggagccggtgccggatcagccgctgctgccggtgcgggagttggagctgctggtggatatggaggtggagccggcgctggagctgtagcaggagcctcggcaggttcatacggaggagctgtcaacagactctcatctgcaggagccgcttcccgagtcagctcaaacgttgcagctatagcctcagctggtgcggctgctttaccaaatgttatctctaatatctacagtggtgttttgtcaagtggagtgagttcctccgaggcccttatccaggcattgttagaggtcatttcagcactgatacatgtccttggatcagcttccatcggtaatgtttcttctgttggtgtgaatagtgcattgaacgccgtccaaaatgctgtcggagcctacgctgga

SEQ ID NO: 101 - DNA, 375 bp, Artificial Sequence
  Description of Artificial Sequence: Synthetic polynucleotide
ggtcagggtggatatggtggaagcgcttacggtggccagggcgctactgcttcggctgcggcagcctcagctgctgccagtagattgtcctctccatccgcagcatctagagtttcttccgcagtctcaagccttgtgagcaatggaggtcctacatcaccagcagctttgagctctagcatttccaacgtggtatctcagatctctgcatcaaacccaggactttctggttgtgatatattggttcaagctctattagaaattatttctgcattagtgcatattctaggaagttcatccattggtcaggtaaacagctcgagtgccggacaatctgcctccattgtcggacaaagcgtgtatagggcactgtca

SEQ ID NO: 102 - DNA, 501 bp, Artificial Sequence
  Description of Artificial Sequence: Synthetic polynucleotide
ggtggtccaggtggccctggtggtcgtggaggaccaggacgttcaggtggtagaggaggcctcgaaggtgctggtgcatcgggaggtttcggacctgtagcgggaggagcttcacccggagcaggtggttctggttctactactgtcaccgaagttgttagtgtgaccgtatccggaggacaacctagttcaggcgtgctgccgggtggctcttacacccctgccgccggtggatccgctcgtttaccttccctgataaatggaatcatgtcctctatgcagggtggaggattcaactatcaaaatttcggaaacgtcttatctcagttctccactggtaccggaacgtgtaatagtaatgacttaaacctgctaatggatgcactattagcagcattgcatactctatcgtaccaaggtatgtccactgtcccatcttacccatccccgtctgctatgtctagttattctcagtcagtcaggagatgctttggatattca

SEQ ID NO: 103 - DNA, 363 bp, Artificial Sequence
  Description of Artificial Sequence: Synthetic polynucleotide
ggtgtcggaccgggaggtgcttatggtccaggtgccggaggactgtctggagtgtctagtggtgctggaggaattagaggtggtcaaacctacggaggatcttctagattaccatctttagtgaatggactcatgggatccatgcagccttctggtttcaactatcagaacttcggtaacgttatgtctcaatatgcaactggatctggtacgtgtaacagtaatgacgttaacttactaatggacgccctcatggcagctttacattgcttatcttacggatcaggatcggttccacctacccctacctactcggccatgtccgcttacaatcaatccataagacgaatgttcgcatactca

SEQ ID NO: 104 - DNA, 363 bp, Artificial Sequence
  Description of Artificial Sequence: Synthetic polynucleotide
ggtcagcagggttactcatctagctcaagcgctggcgctagctctgccgcaacggccagcgcagccgcttctagactcagtagtaccgattccagttcacgagtatccagtgctgtatctagcctggtcagtaatggaccttctaacccggtggccttagctaatgctgtttctcgtgttatgtcgcaagtgaatgcttcctcttctggtttatcagaatgcgacgttttggtgcaagctttgctcgaaatcttaagtgccctggtacatatacttggaagcgctactgtcggcgaagttaattacgacgctacatcacaaaccgcacaaatggtcagccagactatagctcaggtattcgca

SEQ ID NO: 105 - DNA, 396 bp, Artificial Sequence
  Description of Artificial Sequence: Synthetic polynucleotide
ggtccaggaccgcagggtccatctggtcctggtccacaaggtccttctcctcaaggaccaagcagtggatatgatcagtcggtcgtaattagctcagcaagttcccgtttgtcatctcctagtgcgacttcccgtatctcttcggcaatttcaacgctaaagacttcgggtcctagaaacccagtgggattgtcaactgccttaggtaatatcctaagccaaattcaattgacaaatcccggtctgtcgggttgcgaatctttagttcaggcccttttagagattgtgtcagctctgatccaaatcttatctgtcagtagtgtaggacctgttgatttctccgctactggacaaagtgccgctatcgtgggacaagctttgatgcaatcactagga

SEQ ID NO: 106 - DNA, 462 bp, Artificial Sequence
  Description of Artificial Sequence: Synthetic polynucleotide
ggtggagcagcaggttccggagttggatacggtggtgcttcaggtgttgttactagttcctcaagcgcttccgcaggaggttcgggtatcataacttatggtggttatggatatggagctggtgctgctgcaggtgccggtgctggtgccgtcgccggttcctatggaggcgcagttaatagacttagttcagctgaagctacgaaccgtgtctcaagcaatgtcggagcaatagttagcggtggcgtgtcagcactaccatcggtaatttcgaacatcttttcaggagtgaatgcatcggctgcaggagccagctatggcgaagcactgattcaatctcttatggaagtggtatcagtgctcctacacattttgtctaattctagtatcggttatgttagtagtgagggtctgggcaattctttaagcgtcgtccaacaagcaattggacctctcgctgga

SEQ ID NO: 107 - DNA, 420 bp, Artificial Sequence
  Description of Artificial Sequence: Synthetic polynucleotide
ggttcgtcatttgcgaatgcagcttccgctgcacccgctgtttcagttgatggtcctgtagttgtctctggtcaagtcctaccggcttctttgttgactgctcttgcaccagttgtgtccagttctggcctagcatcctcaacggcctctgctagagtttccagcttggcacaaagcatagctagtgccattagcagtagtggtggaacactatctgtaccaacctttctcaatttgctctcttcggctggtgcccaagtcactaccagcagtactttgaattcttcacaagttacgtctcaggtattattagagggtatcgccgcccttttgcaagtgatcaacggagcccaaatccgaagcgttaatttggcaaacgccccaaacgttcagcaagcacttgtatcagcattggcggga

SEQ ID NO: 108 - DNA, 591 bp, Artificial Sequence
  Description of Artificial Sequence: Synthetic polynucleotide
ggtcaaggtaccagtttcgctagctccgctaccgccggaatacgaaatatcttcggcaaccctaacactgcaaataattttgtcgactgtttgaagggaggaattcaagcttcacctgcgtttccacgtcaagagcaagccgacattcaatcgattgcctctagcattctgtccgctggtaacaccgcaacgaagtctaaagccatcgagcaagctttgtctactgcccttgcctcgtctctcgcagaaatcgttatcaccgaatccggcggtcaggattactctaagcagattaccgatcttaacggaattttgagtaactgtttcatacaaaccacaggagttgagaacaagaggttcgtgaattcgattcagaaccttatccggttgttggctgaatccgcggtttcagaaactactaacagtatccaaatcggtccatacgcttctacctcgtccaactcattttcagattcgtctgccaatgacgcctctggagcttatgccttctcacaaagttcagcctccacgttagcaagctctagcgcttttagttcagctttttcaagcgcttcctcggcctccgccgta

SEQ ID NO: 109 - DNA, 591 bp, Artificial Sequence
  Description of Artificial Sequence: Synthetic polynucleotide
ggtcaatccgtagctgtcacagctgttccgtcagttttctcttccccgaatttggccagtggctttttgcaatgcctgacctttggtattggaaattctcccgcattcccaacccaggagcaacaagatttggacgctatcgctcaagttatactgaatgctgttagcaccaatactggagctactgcctccgcacgagctcaggctttgtcgacagccttagcctcatctttaacagacttgctgatcgcagaatctgccgagtcaaattacaacaatcaattgtctgaacttaccggaatcctatcaaactgttttatccagacgacaggttccgataaccctgcttttgtgtctagaattcaatctctgatctctgttctgtctcaaaacaccgatgtaaacatcattagcacagcaggtctgccaactgctattagtggagcaggtggtttcggatttgccaagactgcatctagctcagcgagccaagcttcagcgtcgagctttgcacaggcctcgtccgctagtttggcagcttcttcgtcgttctcaagtgcctttagttctgcgaatactttatctgcatta

SEQ ID NO: 110 - DNA, 609 bp, Artificial Sequence
  Description of Artificial Sequence: Synthetic polynucleotide
ggtcaaagtgtagccgtcacagccgtcccttcggttttctctagtccaaacctggcttcaggattcttgcaatgcttgaccttcggtataggaaatagccctgcatttccaactcaggaacaacaagacttagacgcaatcgcccaagttattttgaatgccgtctccagtaacaccggagcaactgctagtgcacgagcgcaagccttgagtacagcattggcctcctctttgaccgacctgcttatcgccgagtctgctgaatcaaactactcaaaccagttgtctgaattgacgggtattttgtctgattgttttatccagactactggtagtgacaaccctgcctttgtgtccagaatacaatccttgatctcagtattgtcccagaacgcagatactaatatcatctcctctgcaggtattccatcagtgagtggccgacggggagccggtggtctaggcttcgataataccgccagacaaagcgcatcatccgccgcttcacaagcttctgctagttcatttgcacaggcttctagcgcatcgttggctgcgtcctcagccttctcatcagctttcagttcagctaattccctgagtgcccta

SEQ ID NO: 111 - DNA, 420 bp, Artificial Sequence
  Description of Artificial Sequence: Synthetic polynucleotide
ggtcaacaatcaaagtttggacaaaggtttccatcagtttcgcacatatggaacaggaagttttctcgtatctcgtactctagaacaactcgtcttggttgtcactgtccaggtgatactcaatgtaggttcaaacaacactggcgtcactcaatcggtcagtcatcaggattcaagtactcagcctgcatcttttcttctgctaattcgcttagcgccctgggtaacgtcgcctatcaactgggttttaacgtagctaatactttgggaataggtaacgccccaggtctgggagctgcattgagtcaagctgttagtagcgttggtgttggcgcttcgagctcgacgtacgcaaatgttgtaagtaacgcagtaggacaatttttggcaggtcaaggagtattgaatgccgccaacgca

SEQ ID NO: 112 - DNA, 756 bp, Artificial Sequence
  Description of Artificial Sequence: Synthetic polynucleotide
ggtctcccagcaaactctctgtctggagtgtcggccagtgttaacatattcaactcccctaacgccgcaacctcgttcttaaattgcctgcgctcaaacatagaatcaagtcctgcgtttccttttcaagagcaagccgacctggatagcattgctgaggttattctatctgatgtgtcctctgtcaacaccgcctcctctgctacttccttggctctgagcaccgctttggctagctcacttgctgaactcctagttacggagtcagctgaagaggacatcgacaaccaggttgtggccttgagtactatcttgtcccagtgtttcgttgaaactacgggatccccaaaccctgctttcgttgcttctgttaagtcactcctgggtgttcttagtcaatctgctagcaattacgagtttgtggaaactgctgatgaatctattgcagcaaacgttccaggcataactacaacaggtaacttcacgccgttaaacgcaattgagcaaaattttgtatcaagcctggcgtcgtctccaagtcttgcgcgtacattctactccgtaagcaacgcagatcaggctgcaaacattgcctataacctaggtcttaacattgctccatctttaggtatcccaaattccgaggcacttgcttcaagcttgcgtcaagctgtggcaagcgcaggtgaaggtgttaattcatcaacttacgctaatcttgtatctaacacattgggtcagttcctgagctcgcaa

SEQ ID NO: 113 - DNA, 720 bp, Artificial Sequence
  Description of Artificial Sequence: Synthetic polynucleotide
ggtcaggctatatcagtcgctacgccagttccctcggttttctcttcgccatctttggcttcaggatttcttggatgtttgactaccggtattggtctttcacctgcattcccttttcaagagcaacaagacttagatgatcttgctaaagtaattctttccgctgtaacttcaaatactgatacatccaagtctgctcgcgcccaggctctttcaaccgctctggcatccagtttggccgatctgctgattagtgagagtagtggatcttcttaccagacacaaatctctgcccttacaaatattctgtccgactgtttcgtgacgactacaggatccaataatcctgctttcgtctctagggttcaaactcttattggtgttttgtcccaatcttcaagcaacgccatatcaggcgctactggtggaagtgctttcgcccaatcccaagctttccaacaatctgctagccaaaacacaggcctttccgcatctcgagccggatctacgtctagcagtaccacaacaacgaccagtgccgcagcttctcaggctgcatcccagagtgcatcgagttcaagctcgtatgcctttgctcaagcagcatcgtccagtctggcaacaagctcagcaatctccagagcatttgcatcggtgagttccgcctcggccgcctctagtttggcgtatacaattggattgtctgccgcaagaagttta

SEQ ID NO: 114 - DNA, 522 bp, Artificial Sequence
  Description of Artificial Sequence: Synthetic polynucleotide
ggtcagccaatctggaccaaccctaatgctgccatgacaatgaccaacaatcttgttcagtgtgcaagtagatcaggagttctgacagcagatcaaatggatgacatgggaatgatggccgactcggttaattcccaaatgcagaaaatgggtccaaaccctcctcaacacagactcagggccatgaacactgcaatggctgcagaagtcgcagaagtggttgcgacctctcctccacagtcttactctgctgtgttgaacacaattggtgcttgcttacgcgagtcgatgatgcaagctactggttcggtggacaacgccttcacaaatgaggtgatgcagctggtgaaaatgctatccgctgattctgctaacgaagtttcgacagcttctgcatctggagcctcgtatgctacttctacatcgtctgctgtatcatcttcccaggccacaggttatagtaccgctgccggatatggcaatgcggctggtgctggtgcaggtgcagcagctgcggtgtca

SEQ ID NO: 115 - DNA, 492 bp, Artificial Sequence
  Description of Artificial Sequence: Synthetic polynucleotide
ggtcatatctggggaaccccaggagccggaaagtctgttactggttcgatcgtccagtgcgctggacaatctggagtcttttctggtgatcagatgcaagatcttggagatatggctgacgctgtcaatagacagttagatcgtttgggtccaaacgctccagatcaccgactcaaaggagtgactactatgatggctgctggtattgcggacgccgctgttaactctccgggtcaatcgctagacgtgatgatcaatacaatctctggctgcatgacacaagccatgtctcaagctgttggttatgtcgaccagaccctgattagggaagtcgcagaaatggtcaacatgcttgcaaacgaaaacgcaaacgcggtatctacctctggaggtgttagtggtggatcgtacgaggttagtcagtcctcatctgcttctagtgccaccgctcaggcgggttattcctcttctgtacaatttggaacctcatca

SEQ ID NO: 116 - DNA, 693 bp, Artificial Sequence
  Description of Artificial Sequence: Synthetic polynucleotide
ggtgccttgggtcagggagcttcagtatggagctctcctcaaatggccgaaaattttatgaatggtttttcaatggccctttcccaggcgggtgccttttccggtcaagaaatgaaagactttgatgatgtaagggacattatgaatagcgcaatggacaagatgatcagatctggcaaatctggtaggggcgctatgagggcaatgaacgctgctttcggatccgctatagccgaaatagtggcagcgaatggtggtaaagagtatcaaataggagctgttttggacgctgtcaccaatactctgctacagttgacaggaaacgctgataatggattccttaatgaaatttccagattaatcactctattttccagcgtagaagctaacgatgtttctgctagcgctggtgcagacgcttctggctctagtggacctgttggcggatattcatctggcgcaggcgcagctgtcggtcaaggcactgcccaggctgttggctacggaggcggtgctcaaggagttgcctcatcagctgccgctggagccactaactacgctcagggagtttctactggatcaacacagaacgttgccacctccacagtcactactaccactaatgtagccggatccaccgcaactggttacaacaccggttatggtatcggtgcagcagccggtgctgcagca

SEQ ID NO: 117 - DNA, 795 bp, Artificial Sequence
  Description of Artificial Sequence: Synthetic polynucleotide
ggtagaggaatcattgctaattcgcctttctctaaccctaatacagctgaagcttttgccagatcattcgtgtccaacatcgtttcttcaggtgagttcggtgctcagggtgcagaggacttcgacgatataattcaatctttaattcaagctcaatcgatgggcaagggacgtcacgatacaaaggcgaaggccaaagctatgcaagttgcccttgcaagctctatcgctgaattggttattgctgaatctagcggtggtgacgttcaacgcaagaccaacgtcatttccaacgcattacgaaatgccctgatgtcaaccacaggtagcccaaacgaggaatttgtgcatgaagtccaggaccttattcagatgttatcacaagaacagataaatgaagttgacactagcggccctggtcaatactaccgttcttcatcatcaggaggaggtggtggcggacaaggtggaccagttgttaccgagacacttaccgttactgttggcggatctggaggaggtcaaccaagtggtgcgggaccaagcggtaccggtggctatgcccctacaggttacgctccatctggatcaggcgctggaggtgtaagaccatccgcctcaggtccttccggttcaggtccgtccggtggttctaggccttcaagctctggtcctagcggtacacgtccatctcctaatggtgcctctggttcaagtcctggaggaatcgcaccaggtggatcgaacagcggaggtgcgggagtatctggagctaccggaggaccggcttcctca

SEQ ID NO: 118 - DNA, 717 bp, Artificial Sequence
  Description of Artificial Sequence: Synthetic polynucleotide
ggtcgtggtatcatcgtaaattcccctttttcgaatccaaacactgcggaggcatttgccagatcattcgtttcgaacgttgtttcctctggagagttcggtgcccaaggagctgaagattttgatgatattattcaatctttaattcaagcccagtccatgggaaaaggcagacatgatactaaagccaaagctaaagctatgcaagttgcattggcctcgtccatagctgagttggttatcgctgaatcatctggaggagacgttcaaagaaaaacaaatgtgatttcaaacgctttgagaaacgccctaatgtcgacgactggctctcctaacgaagagttcgtccatgaagttcaagatctaatacaaatgctgagtcaagaacaaatcaacgaggtggatacctctggtccaggtcaatattatcgtagctcttcgtctggtggaggtggtggtggaggaggtggacctgtcataacagaaaccctcacagttaccgtcggtggaagtggagcaggtcagccatcaggagccggtccatcgggaactggtggttatgcgccaacgggttacgctccaagcggctctggtcctggaggagtcagaccatctgctagcggaccttccggttctggtccttctggatcccgtccctcgtcatctggatcttcaggaactcgtcctagcgcaaatgccgctggtggttcgagccca

SEQ ID NO: 119 - DNA, 723 bp, Artificial Sequence
  Description of Artificial Sequence: Synthetic polynucleotide
ggtgttcaagtagagggtcgtaaaggtcatcatcatagctccggttcgtctaaaagcccttgggcaaacccagctaaggcaaacgccttcatgaagtgcctgatacaaaaaatttctacttctcctgttttcccacagcaggaaaaggaggacatggaagagatcgtcgagacaatgatgtcggccttctcaagtatgtctactagtggtggttcgaatgctgccaagctgcaagcaatgaacatggccttcgcttcgtctatggccgaattagtgatcgccgaggacgctgacaacccagacagtatttctattaaaactgaagccttggccaaatccttacagcaatgtttcaaatccactttaggttctgtgaacagacatttcatagctgagattaaagacctcatcggaatgttcgcaagagaggctgcggccatggaggaagcgggcgacgaagaggaagagacatacccatcagcctttgaaatccctgaccaatccatctccgttcctagcgcagattttatttcaggaatggataccttcattggattcggaggaacctctgcttccggtgacgtgtcagctaagttatctaaatctctgctctcttctttggcctcgtctggagtttttagagccgcatttaactcaagggtcagtactcctgttgcagtacagctcactgatgctttggttcagaagatagcgagcaactta

SEQ ID NO: 120 - DNA, 801 bp, Artificial Sequence
  Description of Artificial Sequence: Synthetic polynucleotide
ggtttggattacgccacggcaagtaaattacgtaaggcgtcgcaggctgtttccaaggttagaatgggttctgacaccaacgcttatgctctcgcgatttcctctgcattggctgaggttttgtcaagtagtggaaaagtcgctgacgcaaacataaatcagatagcacctcagttagcttcaggaattgtgctaggtgtctccacaactgctccacagtttggagttgatttatcttccatcaacgttaacctggatatttcgaacgttgcaagaaatatgcaagcctccatccaaggcggcccggctccaattaccgctgagggtcctgattttggagctggttaccctggtggtgcaccaactgacctttctggattagacatgggtgccccatctgacggctctagaggaggtgacgcaaccgcgaaattgcttcaagctcttgttccagctttactaaaatccgacgtattcagagcgatctataaaagaggaacgcgtaaacaggtggtccaatacgttacaaatagcgctttgcaacaggcagcaagttctttaggattggacgctagcacaatttcccagttgcagaccaaggccacgcaagcactatcctcggtgtctgccgatagtgactcaactgcttacgcaaaagcttttggtttggctattgcccaagtgctaggcactagcggtcaagtcaatgatgctaatgtcaaccaaatcggcgctaagttagcaactggaatcttgagaggaagttccgctgtcgccccacgtttgggaattgatttgtca

SEQ ID NO: 121 - DNA, 435 bp, Artificial Sequence
  Description of Artificial Sequence: Synthetic polynucleotide
ggtcaatctaatccgtggacagacacggctacagccgaaagtttcatatcctctgttatgtcctcggttgctaaccaaggttgcttgagctatgaccaaatcgatgatatgcaagccgtgggtgacactatgttagctacaatggacaaccttgtccgatcaggtaagtcatctagccacatgttgaaggccatgaacatggccatgggtacatctatcgctgaaattgttgctgatggcggtggaaatttaggtagcaaagtgtcttgcatctctaacgctctgtctagtgcgtttctacaaacaacaggatccgtcaatacacagtttgtgaacgagatcgtcagcttaatctcgatgttcgcacaagcagacacaaacgaagtcggcgttggatcgggctcaggagcaggagctggaagtggtgctggtgca

SEQ ID NO: 122 - DNA, 507 bp, Artificial Sequence
  Description of Artificial Sequence: Synthetic polynucleotide
ggtgtgggacaagccgcgaccccttgggaaaactcgcaacttgcagaggattttatcaattcttttctcaggttcattgctcagtctggtgcattctccccaaaccaacttgacgatatgtcgtccattggcgatacacttaagacagctatcgagaaaatggcacagtctagaaagtctagtaagagtaaactccaggctctgaacatggctttcgcatcctctatggctgaaattgccgtggcggaacaaggcggactatcactggaagctaagaccaacgctatcgccaatgctttggctagtgcttttctggaaacaaccggattcgttaatcaacagtttgtttccgaaataaagtctttgatctacatgatcgcacaagcttcatcaaacgagatttccggaagcgccgcagccgcaggaggtggcagcggcggtggtggaggatcgggacagggaggctatggtcaaggtgccagtgcgtccgcctcagctgctgcagca

SEQ ID NO: 123 - DNA, 756 bp, Artificial Sequence
  Description of Artificial Sequence: Synthetic polynucleotide
ggtgtttttagcgctggtcaaggtgctactccttgggagaattctcagttggctgagtcttttattagtcgttttttaaggtttattggtcaatccggtgcattctctcctaatcaattggacgatatgtcatcaatcggagacacactgaaaactgccattgaaaaaatggctcaatccagaaaatcttctaagtcaaaattacaggcccttaacatggcatttgcctcctcaatggccgagattgccgttgccgaacaaggaggtttgtccttggaggcaaaaaccaatgctatcgcttcagctctgagtgctgctttcttggaaactaccggttacgtaaaccagcagttcgtgaacgaaatcaaaactctaatcttcatgattgcccaagcttcttctaatgaaatcagcggtagtgctgctgcggcaggaggttcttctggtggaggtggtggcagtggtcaaggaggttatggccaaggtgcttacgctagtgcctctgctgctgctgcgtacggttcagcaccacaaggtactggaggtcctgctagccaaggtccttcccaacagggtccagtatcacaaccttcgtatggtcccagtgccacggttgccgtgactgccgtcggcggtcgtccgcaaggccctagtgccccaagacaacagggacctagtcaacaaggaccaggacagcaaggacctggaggtagaggtccatatggtccttccgccgcagcagctgcagccgctgca

SEQ ID NO: 124 - DNA, 636 bp, Artificial Sequence
  Description of Artificial Sequence: Synthetic polynucleotide
ggtagaaccaaagttactaacgttccttggactgatgaggctaaaggaaaaaagttcctctccacttttcttgactacgcgttagatcatggactcttccctcaacaagagcgtgatgatctagaagccattagtcaaaacttaattccggtttttcgaaagacaatggattctggtggaaacgccgcggctaagatgaaggccttgaatatggcttttgcttcgtctattgcagagatagcagtgcaagaaggtggtgcgggatcaattgaagagaaaactcaggctgtttctgaggctttagctcatgcgttccttcagacaacaggttctgttaacatccaattcattaaagagattagagcactcattacgctgtttgccaaagaaggccaggataacgaaacagaaaacgaaattccaacccagcaagcataccctgagctgcaacctagaggtggcggtttgcaaggccagccaggtcaatacgaatccgttagagcaaactacgccggttccggtggtgctagccgtggtcaagctgcaaaggaagattcaggcgctgctgccgcatcttcttccagcacatccacatcaactactacaactagttcagcagcggctgccgccgctgca

SEQ ID NO: 125 - DNA, 873 bp, Artificial Sequence
  Description of Artificial Sequence: Synthetic polynucleotide
ggtgcttcaagttatgcctctgcaaatactacgccatggcgagacgctgctacagctcaagctttcataggcaattttatgcaagctatctgctatgatcctgttattaatcctcaacagtgcgacgatatgaattctatggcaagcacaatcctggctggtgttcagaacatggccagagatggtaaaatatctaaagcgaagctgcaagctatgaatatgggattcgcatcggccattgctgagattgcacttgtcgaaggaggtgccccagccgaaaacgctgtggttaatgctatgcaatccgctatctggcagagcactggttcgcccaaccgttcctttattaatgaaatgaaagcactcatgaagatgcttgcccaacaatccaatttcgtggccgccgctgcttccactgcagcgtccgccagtagtcaggctaccgccccagcttatggaggaggtagcggtagtgccgttgcatctgcctcttcgcaaggaacagctccagcctatggtggtggctcgggttctgctggtggtcagggtcaaggtcagggttcttccggtcaacaaggccaaacacaaggaacttatcagtacactgttagcatgagcactgctacttctacttatggacagcaatccgccggacaacaaggaggccaaggtggagcccttcaaggtggtcgacaacagggtggccaaggtccaaacggaccaggagcttctgccgccgcatccgcttccgctggagcaccagctgctgctgctcctggaggatatggtggtccaggtcagcaaggacctggtcaaggacagaaaggaccagcgacttcagcagcagctgccgccgcgagcgcaactgcagca

SEQ ID NO: 126 - DNA, 744 bp, Artificial Sequence
  Description of Artificial Sequence: Synthetic polynucleotide
ggtcaccagggacctcatcgaaagacgccctgggaaacaccagaaatggctgaaaacttcatgaataacgtaagagaaaaccttgaagcatctagaatcttccctgacgagttgatgaaagacatggaggctataaccaacaccatgattgctgctgttgacggtctggaggctcagcatcgatctagctatgcatcccttcaggctatgaacacagctttcgccagtagcatggctcaattatttgcaacagagcaagattatgtggataccgaagtcattgccggtgctattggtaaagcctaccagcaaattactggttacgagaatccgcacttagctagtgaggttactcgactgattcaattatttcgcgaggaggatgatttggagaatgaagtagaaatatccttcgccgatactgacaatgccattgctagagcggctgctggtgctgccgctggatcagctgctgcttcttcctcagccgatgcttcagcgacagctgaaggtgcatcaggtgatagtggtttcttattttccacaggaacctttggaagaggtggtgctggtgcaggcgcaggagctgctgctgcatccgccgccgcagcttctgccgcagcagcaggtgccgagggcgacaggggtttgtttttcagtacaggtgattttggtcgtggaggagccggagctggtgccggtgctgctgcagcctcagccgctgccgcttcggctgccgcagca

SEQ ID NO: 127 - DNA, 429 bp, Artificial Sequence
  Description of Artificial Sequence: Synthetic polynucleotide
ggtaacacaccattcgctaataaaattatggccgaagattttatgaataaatttacaaaccaactggccaatagcccatatttctcctcacagcaaaaagaagatatgagttctatcaaggacgagcttatatctgtaatagagagtatggattcggctcacaaatcttcagcggcaaaactacaggctatgaacatggccttcgcgagtgctattgcagatatcgctgctactgaagcttatggtgctgacatctctctcgagacgtccgcaatcgctaacgcactttctgaagccttcctgcagaccaccggtgtggtcaataagaggttcatcagtgagatccaagaattgatttatatgttcgctcaggacgccagcgtccaatctaatgagattgcctcctcctcgtctgctgctgcagctgca

SEQ ID NO: 128 - DNA, 534 bp, Artificial Sequence
  Description of Artificial Sequence: Synthetic polynucleotide
ggtagtagctctcttgcttcacataccaccccttggaccaatcctggactagcagaaaactttatgaactcttttatgcaaggtttgtcctcgatgccaggatttactgcaagtcaactggatgatatgagtaccattgctcaatctatggtacaatcaatccaatcgctcgcagcacaaggaaggacttctccaaataagttacaagcactaaatatggcttttgcaagttctatggccgaaatcgcagctagcgaagaaggtggaggcagcctgtctactaagacctcaagtattgcttctgctatgagcaatgcttttctgcaaaccacaggtgttgtcaaccaaccattcattaacgaaatcacgcagcttgtgtccatgttcgcacaagctggtatgaatgacgtaagtgcttccgcttcggcaggtgcctctgccgctgcttcggccggtgcacctggatactctccggctccgtcttactcctctggtggatacgcaagctcagcagcttccgccgccgcagctgca

SEQ ID NO: 129 - DNA, 471 bp, Artificial Sequence
  Description of Artificial Sequence: Synthetic polynucleotide
ggttttgttgttcaaggtcgccaacataacgccgctaattccccatggtccaacgctaagaccgccgagatttttatttctaaatttatcagcgcgatcctggactccaatgcattcacacgtgaacaaaaggaagatatgatgtctataggtgaaaccatcatcccagctatggagaagatgtctggtagttcgaagtccatacatgctaagctaaccgctctgaacatggctttcgcctcttctgtcgctgaaattgctgtggttgaggagggtggatccgacattaacgagaaaacatacgccatcgtggctgctctcaaccaagcctttctggatacaacgggaaaagttaataaacaattcattgcagagatcagggatttggtcaaaatgtttgcatcagctaacgaagaaaacgaaataggtgcggcgctatcagctgagatttacacggaacaaactggctca

SEQ ID NO: 130 - DNA, 648 bp, Artificial Sequence
  Description of Artificial Sequence: Synthetic polynucleotide
ggtagagcatacggagcaggagctggcgctggtgctgaagagggttacggtgctggtcaaggtatagccaacgcagttggaagaagaagggacagaactggtagaggtgtctttactgttagcactgtttcctccaatgtagttagtcagtccgaaggtctagttgaggacacgggcccaagtggagagggagaaagcgctgtttcttccgctgcatccgccgcaagtgctgctcaaacaggtccagaaagaacaggaagtgaaggtgcttcgacgagaggaggtgctggagcaggaagaggcttcggtgccggcgccggtgcaggagctgagtcaggcaaaggaggatacggttccggttctggagctggtgctggcgctggtgccggtgcttcaggcgagggaggcttcggtgaaggtcagggatacggtgctggtgctggtgcgggcgcttcggctggtgctggcgttggaagtggagcaggcgctggagccggatacggtgccggagcaggcgccggtgccggttttggcgtcggagccggagcaggtgccggagctggcgcaggatttggttccggtgcaggtgccggatctggtgcaggcgctggatatggtgccggaagagccggtggtcgtggacgtgga

SEQ ID NO: 131 - DNA, 534 bp, Artificial Sequence
  Description of Artificial Sequence: Synthetic polynucleotide
ggtcaaaatactccatggtcatctactgagctggctgatgcttttatcaacgcgtttatgaatgaagccggtcgaactggtgcttttactgctgatcaactagacgacatgtctactattggagatacgataaagacagccatggataagatggccagatccaacaagagcagtaagggtaaattacaagcgctgaatatggctttcgcatcatctatggctgaaattgccgctgtggaacagggaggcctctcagtggatgccaaaactaacgccattgctgactccctcaatagcgctttttaccaaactacaggagctgctaaccctcagtttgtcaatgaaatcagatctcttataaatatgttcgctcaatcgtctgccaacgaggtttcttacggcggaggatacggcggtcaaagtgcaggcgctgccgcaagtgcagcagcagctggtggcggtggccagggtggctacggcaatctgggcggacaaggtgctggagctgcagctgcggcagccgcttcagcagca

SEQ ID NO: 132 - DNA, 534 bp, Artificial Sequence
  Description of Artificial Sequence: Synthetic polynucleotide
ggtcaaaacacgccttggtcctccaccgagcttgctgatgcctttattaacgctttcttaaacgaggctggacggactggtgcttttaccgccgatcaattagacgacatgtctacaatcggtgatactttgaaaacagccatggataagatggctaggtcaaacaaatcttctcaatcgaaattgcaagctctgaacatggctttcgcatctagtatggcagagattgctgctgtagaacaaggtggcttgagtgtggctgaaaaaactaacgccattgctgattcacttaatagtgcattttatcagacgaccggtgctgtaaatgtacaatttgtaaacgaaataagatccctcatttccatgtttgctcaagcttcggcaaatgaagtctcctatggaggcggatatggcggtggccaaggtggtcaaagtgctggtgctgcagcagctgcagcttccgcaggtgccggacagggcggatacggtggactaggtggacaaggagcaggttccgcagccgctgctgccgca

SEQ ID NO: 133 - DNA, 435 bp, Artificial Sequence
  Description of Artificial Sequence: Synthetic polynucleotide
ggtcaggccagatcaccttggtcagatactgcgaccgctgatgcttttattcaaaactttctggctgccgtctccggatccggtgctttcaccagcgatcaattggacgatatgtctactataggtgacaccattatgtctgctatggataagatggcaagatcgaacaagagttcacagcataaactgcaggccttgaacatggcattcgctagttctatggctgagatagccgcagttgagcagggtggcatgtccatggcagtcaagaccaatgcaattgtcgatggactaaactcggctttttatatgactactggtgccgccaaccctcaatttgtcaacgagatgcgatcgctgatttctatgatttcagctgcatcagctaacgaagtgtcatatggaggaggagcatctgccgctgctgccgcagca

SEQ ID NO: 134 - DNA, 651 bp, Artificial Sequence
  Description of Artificial Sequence: Synthetic polynucleotide
ggtattttcattgccggtcaagctaatactccatggtctgacactgctaccgccgatgcattcatccaaaatttcttgggtgcagtctcgggcagtggtgcttttactccagatcaactcgacgacatgagtaccgttggagatactatcatgtctgctatggataaaatggcacgcagtaacaaaagtagtaaatcaaagctccaagcacttaacatggcatttgccagttccatggctgagatcgcagccgtggagcaaggaggccaatccatggacgttaaaacaaatgctattgccaatgcacttgattccgcattttatatgacaactggtagtaccaatcaacagttcgttaatgagatgcgatcattgatcaatatgctgtcagccgccgctgttaatgaagtttcctacggtggaggagcatcagcggctgcagccaccgctggaagctacggacagggtcctagcggttacgctcaaggttcatccgctgcaagtgctgcagctccgtcaggttatgtcccctcccaaacaggacaatctggtctgggtgccgctgctgctgcagcagctgtagccccttccggatatggtccaagtcagcaaggtccatcaggtccgggtgcagctacagccgctgccgca

SEQ ID NO: 135 - DNA, 438 bp, Artificial Sequence
  Description of Artificial Sequence: Synthetic polynucleotide
ggtcagaatgttgctgattctccttggtctagcaatgagaaggctgattttttcattcgttctttcaacgaagtcatatccaggtcctcggcatttacttctcaacagatcgatgatatgagtagtattggcgaaacattaatcagctccatcgataacatggccaagaatggtagatccagcactaagaagctacaagccttgaatatggcgttcgcttcatcaatggcagagattgcaatcgcagaacaaggcggtcagagtattgatgttaaaacaaatgcaattattgacgcactaaacgaagcatttattcgtacttcgggttctgtcaacaacgaattcatctcggaaattcggcagctaattcttatgttcagtcaagtttcgatgaatgattccgcttccggtagcaccgctgccgcaaacgcaggcgca

SEQ ID NO: 136 - DNA, 540 bp, Artificial Sequence
  Description of Artificial Sequence: Synthetic polynucleotide
ggtgctaggggaattcacgtttcttcttataccccattcgcagacccatacacagctgagaactttgctcgcgctttcgttaataacattgttaactcaggtgagtttggtgctcaagacgcagccgactttgacgatattacgcagtcactcttgcaagctcaaaatttacacaaacgtcatgacagtaatgctaaggcaaaagctatgcaaatggcctttgcttcctctattgctgaactagttatcgcggaatcggaaggagcaaacattcaaaggcgtacatccacagtatctaactgtatgcgtaacgcaatgcaatcaacgaccggtggtgtggacgaagagtttatgcgtgaaattgaggacttgattcatctgttctcacaagaaagttttaacgaagtcgaaaactacggtcctggtacatattaccagtcgtctactacaggcggagctcctgtggtgaccgagtctgtcactgttaccgtagcaggtggcggacgtggcgctccagttaatcaaggaggacaagcccca

SEQ ID NO: 137 - DNA, 519 bp, Artificial Sequence
  Description of Artificial Sequence: Synthetic polynucleotide
ggtggaggtccaactccctgggattcaccatcaatggccgagtcattcatgagtaacttcatgtctggaattgcttccagtggcgctttctctggcggacagatcggagatatgcaagatattacaggaaccatgcaggattctgtaaataagatggcctctactggaaggtcgtcaaaatctaaactccaggcaatgaatatggcattcgcatcgtctatggccgaaatcgcagctgcggaggcaggtggatcctctatggctgccaagactagtgctatcacaaatgccctaaggggtgctttcttgcaaacaacaggagtttctaatgagcagtttatcaacgaaattgctacgttgattaacctgatctctcaatccaacgtgaatacagtatcagcttcggcttccgcaggaggtggtggaggttacggcgcccctgcttatggtccttcatcttacggtccatcccaaggaccttcgtcagtgtcatccgttagcgtctcctcatcagctgca

SEQ ID NO: 138 - DNA, 531 bp, Artificial Sequence
  Description of Artificial Sequence: Synthetic polynucleotide
ggtagaggaattcatgtttcaattctttcaaatccgaatactgctatgaccttcgctcgtactttcgtctctaacattgctggatgtggcgaatttggatcgcagggtaccgaggatttcgatgacattatgcaatctcttattcaagctcagtccatgggaaagggtagacatgacaccaatgctaaggctaaggccatgcaaatggccctagccagctctattgctgaattgattgtagaagagtccggtggagtaaatatgcaacaaaaaaccaacgccgccattaacgctctgcgtaacgctttgcgttctacaagtggtaaggtagatgagggatttgtgagtgagattgtggaactcgtgaatttgttttcacaagaacagtttaacgaggtcgataccggatcatcacgtcaatactaccaatcctcgaccggtggtggccagggaggagctccaaccgtaactgaaactgttactgtatctgtcggaggaggtggaggtggtgctgcccagtccagtggacca

SEQ ID NO: 139 - DNA, 489 bp, Artificial Sequence
  Description of Artificial Sequence: Synthetic polynucleotide
ggttacccccaacagaactatcagcctggaattggcatagcccaagacgatccattacttgatgaaggaaccggtgagaatttcgcggatgttttcactcaaaccttggaaaactgtggtgcttttactcacgacgaggctcaggagtataaagaaattattcgtgtgctgacgaaagcattcggatcattcccggacctgcagaaggctccacctggtgttctgaaagctacagccgccggtttcgcttcagcggtggcggaacgaactgctgctgatgttgaccacggacagttgtttgcaaagacacgatgtgtaatccaggctttgagagaggcattcatcgttactacgggagttactaacccatattttatatccgaggtggaaagattgatcgaagttttctatattaccaagggtctacctcactctcctgtccagcaacctctagaagaaccacaaggtcaagtacaataccaacaacaa

SEQ ID NO: 140 - DNA, 540 bp, Artificial Sequence
  Description of Artificial Sequence: Synthetic polynucleotide
ggtgcatcacctactttttctcgaagtccttgggctaaccctgctaaggcttcttcacttatgaactgtctcatcactaaaatcgcatcatcaaacgttctacctcaacaggaaaaagaagatcttgagtcaatcatggataccttgatgtctgctataaagggtgcctccgcaaaaggaaagtcatctggtgctcaattgcaggccattaatatggcagtcgcttctagtttggctgagatcgtcgtcgctgaagatgtaggtaaccaagcttcgatggctgtcaaaactcaggccctgtcgggagccctagagcagtgtttccagaccgtgatgggaacggttgaccgaaagttcattaaggagattaatgacttgatcagtatgtttgctagacaagccgctacggaggctaatgaaattcaggaccagggcggtttttacgccgccggtagttcggactctactagcttccaggcaacgtctcgcactttacagggatcttcacaaacgacaggaggattcggaggagcatatcca

SEQ ID NO: 141 - DNA, 501 bp, Artificial Sequence
  Description of Artificial Sequence: Synthetic polynucleotide
ggtcagtccaaccctgttaacgatgatccgtatggctttaatgaaaccgagaagaagttttctgacgttttcgtggataatgtcattaattcagatgccttcactctaatgggtgaaaacgacattgaagaggtgacgaacattttgctgacgtccatacaactccttaagaagtctcaggatggagatgcgaatcaaaaaaagaccttgatggtagcttttgcgtctagtatggccgaacttattttggatagatgtgacactacattaggtatcgaacataagaccgagattataacaaatgccttgaagaatgcttacctacaaaccacaggaaagcccaataagcctctgatcaaggaggtcaggttccttgttgcactgtttttgacactggagtccccaggttttttagatcctttgtggaatccatacggaagaaatccagctttcggactgccaccatcctatggagttccactatacccagcgcccccacaa

SEQ ID NO: 142 - DNA, 447 bp, Artificial Sequence
  Description of Artificial Sequence: Synthetic polynucleotide
ggtcttggacagtccccgtggaaggacgcctcaatagctgagtcattcatgaataacttctctaacgcgcttgcccgctccggagctttttcgagtgaccagatggacgacatcatgtctatttgtgactcaattcagtctggaattgtcagaatggatcggtcaggtaaaacttctgctaataagttgcaagctatgaatatggcttttgcctccgctgtggcagaaatcgcaattgccgagggtggaggacaatctgctcaagtcaagacaaacgctgtcgcagacgctttagccagtgcttttctacaaacaaccggagtggtaaacacacagtttatcaacgaaataagaactttaatctctatgtttgctcaggctaacgttatcgattcctcttcgggtagtgtttccgcaagcgctggtggagctggtcaaggaggagca

SEQ ID NO: 143 - DNA, 600 bp, Artificial Sequence
  Description of Artificial Sequence: Synthetic polynucleotide
ggtttcggccaggcagctaccccatgggagaacactgccttggcggaagcctttatcaataagtttttggaatcaattggacaaactggaaccttttcggctagccagcaggacgacatggcgacgattggagacactcttaagaccgccatggaaaaaatggctcaatctaggaaatcctcgaagtctaaattacaagctcttaatatggctttcgcttcatctatggctgaaattgcagtggctgaacagggaggtttgtcaattcaggcaaaaacggaagcaatagcttcagctctgtcgagcgcttttttgcaaacaacgggtgtgattaattaccaattcgttaacgagatcaaatcgttgatatacatgatcgcccaagctagcactaacgaggtcggttcttccgccgcgtcggctggaggtggatccggtggaggtagctacggacagggttcctacgtatctgcttctgctgcgggtacatacggttctgctcctcaacagggcggttacgcacctgcacagggtccttcccaacaaggacctgtgtcccaaggtccatatggtccgagtgcctctgttgccgccgcagca

SEQ ID NO: 144 - DNA, 384 bp, Artificial Sequence
  Description of Artificial Sequence: Synthetic polynucleotide
ggtcaacaaatttggacaaatcaggctgctgtaatggcaatgaccaacaattttgttggatgtgctagccagtccggcatgctcagtgctgatcaaatggatgacatggctatgatggcagacaccattaacatgcaagcaacgaggatgggtcctaatgctcccagacacaaattgaaggcactcaactctgctatggccgcttctattgctgaagtcgctgctagttccccaccacaatcctattccgccgtgttgaatgctattggatcctgcctgagggactcaatgatgcaggcgactggtgcagttgatgaaattttcacaaccgaagtgatgaagatggtgaacctattcgctatggataacgctaactcggtatca

SEQ ID NO: 145 - DNA, 522 bp, Artificial Sequence
  Description of Artificial Sequence: Synthetic polynucleotide
ggtcagaagatttggactaacccagatgccgcaatggccatgacgaacaatttagtccaatgcgctggtcgtagcggagcattgactgccgatcagatggacgacttgggtatggtttctgactctgtaaattcccaagtaaggaagatgggagctaatgctccacctcataaaattaaagccatgagtaccgctgttgccgctggtgttgcagaagtcgttgcttcttccccaccccaatcctattctgccgttttaaacactattggaggatgtttacgagaatccatgatgcaggttacgggttcagttgataacactttcactactgagatgatgcaaatggtcaacatgtttgctgccgataacgccaacgaagtgtcagctagtgcttccggcagtggagcctcctatgccactggtacctccagcgctgtgtcaacttcgcaggctacaggatattctacagctggtggatacggcacagcagccggcgccggagcaggagctgctgctgccgca

SEQ ID NO: 146 - DNA, 543 bp, Artificial Sequence
  Description of Artificial Sequence: Synthetic polynucleotide
ggtgctgcatctagtagtagcactatcatcacaacaaaaagcgcttccgctagcgctgccgcagacgccagtgctgctgctactgcctccgctgccagcagatctagtgccaatgcagcagcatcagcgtttgctcagtctttttcctccattctgttagagagtggatacttctgtagtatctttggatcatccatttcatcttcttatgcagccgccattgcttctgcagcatcacgcgcagccgctgagtcaaatggctacacaactcacgcttatgcgtgtgcaaaagctgtagcttctgccgtagaacgtgttacttctggagccgatgcttatgcctatgcccaagcaatttccgatgctctatctcacgcgctcctctacactggcagactcaacactgctaatgctaactcattggcaagtgcgtttgcttacgctttcgctaatgccgctgcacaagcaagtgcatcatcagcttctgctggagccgcctctgctagtggtgcggccagtgcctcgggtgcaggatccgcttca

SEQ ID NO: 147 - DNA, 543 bp, Artificial Sequence
  Description of Artificial Sequence: Synthetic polynucleotide
ggtgcagcttcaagttcatcgacaatcatcaccacaaaatccgccagtgccccagctgctgctgatgctagtgctgccgccacctcatctgcagcttctagatcctctgctaacgcagccgcatccgcatttgcgcaatcatttagtagcatcttgctcgaatcaggatattttggttctatttttggatctagtatatcttcaagctacgcagctgctatcgcttctgccgccagtcgtgctgctgcagaatccaatggatacacaacacacgcatacgcatgcgcaaaggctgtagcatcagctgttgaacgcgtgacttcaggtgcagacgcatatgcatatgcacaggctatttctgatgcgttgtcccatgcattgttgtacacgggtcgacttaataccgccaacgcaaactctctcgcctctgcgtttgcttatgcttttgcaaacgccgctgcgcaggccagtgcgagttcagcctccgctggagctgcatctgcctccggtgcagcatctgcttcaggagctggatccgcttca

SEQ ID NO: 148 - DNA, 543 bp, Artificial Sequence
  Description of Artificial Sequence: Synthetic polynucleotide
ggtgcagcttcgtcctctagtaccattataactactaaaagtgctagtgcttccgcggcagctgatgcttctgctgcagctactgcatccgcggccagcagatcctctgcaaatgctgcagcaagtgcatttgctcaaagattctcctctattctgctggagtcgggatacttctgttctattttcggttcttccatttctagttcttatgcggctgccattgcttctgcagcgtcgagagctgcagctgaatccaatggatacactactcatgcttacgcatgtgcaaaggcagttgcaagtgccgtcgaaagagtcacctccggtgccgatgcctacgcttacgcacaagccatctctggtgcactctcacacgctttactttatacgggaagattgaatacggcaaacgctaactctttggcttcagcttttgcttacgctttcgctaacgctgcagctcaggccagtgctagttcggcttccgcaggtgcagcctcagcctcaggagctgctagcgcctctggagctggtagcgcttca

SEQ ID NO: 149 - DNA, 543 bp, Artificial Sequence
  Description of Artificial Sequence: Synthetic polynucleotide
ggtgcagcttcatcatcttcaactatcattacaactaaatcggcttcagcctcggctgctgcagatgcgtcagctgcggcgactgcgtctgcagctagtaggtcctctgcgaacgcagccgcaagtgcctttgctcaatcgttctcatccatccttttggaatccggatacttctgctctattttcggatcgtcaatctcctcaagttacgctgcagctatcgcctccgcagccagtagggctgctgccgaaagtaatggttacacgacccacgcatatgcttgtgcaaaggcagttgcctccgctgttgaaagagttacatcgggagccgatgcatacgcctatgctcaggctatttccgatgcattatcccatgcactattgtatacaggtagattgaataccgcaaacgccaatagtttggcttcggcttttgcatacgctttcgcaaatgcagcagcccaagcttctgcttcatcagcttcagctggcgccgctagtgcctcaggagctgctagtgcttccggagcaggttccgcctca

SEQ ID NO: 150 - DNA, 543 bp, Artificial Sequence
  Description of Artificial Sequence: Synthetic polynucleotide
ggtgctgcatcttccagttcgactataataaccaccaagtcagccagtgcatcagcagctgcagatgcttcagctgctgctaccgcctctgctgcatctcgatcctccgccaatgcagcggctagtgcctttgcgcaatctttctcttccatcttgctagagtctggttatttttgttcgatttttggatcatccatatcttcatcatatgcagccgcgatcgcgtctgctgcaagtagggctgccgcagaaagtaatggttacacgacccatgcatatgcctgtgcaaaagctgtagctagtgcagttgaaagagtaacctcaggcgctgacgcttacgcctatgcccaagctattagcggcgcacttagtcatgctctgttgtacactggtcggttaaatacagctaacgctaactctttagccagtgccttcgcatacgctttcgcaaacgctgccgcccaggcctcagcttcttctgcctccgcaggtgcagcatcagcttcaggagcagctagcgcctcaggtgcaggttcagcctca

SEQ ID NO: 151 - DNA, 543 bp, Artificial Sequence
  Description of Artificial Sequence: Synthetic polynucleotide
ggtgcagcatcatctagttctactatcataactactaaatcggctagcgccagtgctgctgcagacgcatcagcagctgcaactagttcggccgcctccaggtctagcgccaatgcggccgcttctgcctttgctcaaagtttttcctctattttgctggaaagtggatatttcggttccattttcggttcttctatttccagcagttatgccgccgcaattgctagtgctgcctcgcgagcggctgcggagagtaatggatatactactcacgcctatgcctgtgccaaagcagtcgctagtgcagtagaaagagttacctcaggtgccgatgcatatgcctatgctcaggcaatttcgggagctctttcacatgccttgttgtacaccggtagattgaatacggctaatgctaactcattggcatcagacttcgcttacgcattcgcaaacgcagccgctcaagctaccgcctcttccgcctctgcaggagcagcttcggcctccggtgctgcttctgcatctggtgccgcatccgcatca

SEQ ID NO: 152 - DNA, 543 bp, Artificial Sequence
  Description of Artificial Sequence: Synthetic polynucleotide
ggtgcagctagttcctcttcaactataattactactaaatcagcatctgcaagcgctgccgccgacgcatcggcggcagctacagcatcagccgcgtctagatccagtgcaaacgcggctgctagtgcctttgcacaaagctttagttccatattgttggagagcggttatttcggttctatttttggatcttccatttctagctcctatgcagccgcgattgcttcagctgcttctagagctgctgctgaatccaacggatacacaacacatgcttatgcttgtgcaaaggctgtcgcttctgccgtcgagagagtcaccagcggagccgatgcctatgcctacgctcaagcgatctccggtgccttgtcttatgcactcctttacacaggtagactgaatactgctaacgcaaactcattggctagtagctttgcttacgcttttgcaaacgctgcagctcaggcttctgctagcagtgcgtccgctggagcagcatccgcttctggtgcggcttctgcctccggagcagcttccgcttca

SEQ ID NO: 153 - DNA, 507 bp, Artificial Sequence
  Description of Artificial Sequence: Synthetic polynucleotide
ggtgccgctgctacatcttcatcgaccagcggagcctcggcctctagtatttcgtccacaactgcctcaagttcttctacaggagcaagttcagctgccgctggagctagtcacggagcagcttcggcgggtggagcatttgattttacgagagctctattttctgaactgctagaatctaagatattttccgccaccacggcaaactttcatagttccacaacggcttctgaaactctttacgccaccattctgaagtgccttagggaattacacttcaggtacgacgaatgcttgcaaggtgcaactgaagtggtgagtgatttgtctgtagtatccgttggttctggagttcacaactacgctagagttattgcagctttctttgaacgcttctttcgaaagcacgacatcccattgtccgcaaactatgcttccagagttgcacagtatttaatttcagctatgggcagttcggtagcttccgcagacgcttcgtcgtcatca

SEQ ID NO: 154 - DNA, 507 bp, Artificial Sequence
  Description of Artificial Sequence: Synthetic polynucleotide
ggtgcggctgccactagttcctctacttctggtgcatcagccagcagcatctcctcaacaactgcttcctctagtagtactggagctagttctgctgcggctggtgcctcgcacggtgccgcctcagctggtggagcgttcgatttcacacgcgcattgtttagcgaactgttggaaagtaaaattttctcagctaccaccgcgaacttccattcttcaacgactgccagtgagactttgtatgctacgatactgaagtgtttgcgtgagttgcacttcagatacgatgaatgtctgcagggagcaaccgaagttgttagtgatttgtctgtagtgagtgtaggatctggagtccacaactatgctcaagttatcgctgcctttttcgaaagattcttcaggaaacacgatattcctctgtcggcaaattatgcctctagagtagcccagtatctcattagcgctatgggctcaagcgttgcaagcgcagatgcttcgtcctcatca

SEQ ID NO: 155 - DNA, 507 bp, Artificial Sequence
  Description of Artificial Sequence: Synthetic polynucleotide
ggtgcagcggctacgtccagcagcacatctggagcctcagcatcttccatttcatcaaccactgcatcaagctcaagtacgggagcttcctccgctgcagctggcgccagtcacggtgctgcatccgccggtggcgcattcgattttacaagagctttattttcagaactgctggaatcaaaaattttttctgccactaccgcgaattttcattcgtccaccactgcttctgagacactttacgccaccatattaaaatgtttgcgtgaattgcactttcgatatgatgaatgcctacaaggagctacagaggttgtatcggatctgtctgtcgtgtccgttggaagcggtgttcataactacgcacgcgttatcgccgctttcttcgaaaggttttttagaaagcacgacatcccactgtcagctaactatgcttctagggttgctcaatacctgatctcagcaatgggatctagcgtcgctagtgctgatgcgtcctcctcttca

SEQ ID NO: 156 - DNA, 507 bp, Artificial Sequence
  Description of Artificial Sequence: Synthetic polynucleotide
ggtgcagctgcaacaagttcatcgacttctggcgctagcgcttcatcaatatcttcgactacagctagcagtagttccacaggtgcttcatcggcagcagcaggagcaagtcatggtgccgcttcggcgggaggagcttttgatttcacaagagccctattttctgagctactcgaatctaaaatcttctccgctacaaccgctaatttccactcatcaactacggcctcagaaacattgtatgcgactattcttaaatgcctaagggagttacactttcgttatgatgaatgcttgcaaggagcgactgaggtagtgagtgacctctctgtagtatctgtcggcagtggtgttcataactatgccagggtaatcgccgcattcttcgagcgattttttagaaaacacgatataccacttagtgctaattacgcctcccgggtggcacagtacttgatttctgcaatgggttctagcgttgcttctgcagatgcctcttccagttca

SEQ ID NO: 157 - DNA, 507 bp, Artificial Sequence
  Description of Artificial Sequence: Synthetic polynucleotide
ggtgcagccgccacaagtagctccacatctggtgcctcagcttcatctatttcctcaactacagccagctcttccagtactggagcttctagcgcagcagctggtgcttcacatggagcagcttccgctggaggtgctttcgacttcacaagagccttgttctctgagctgctggagtcgaaaatcttctctgcaacaactgctaatttccattcgtcaactactgctagtgaaactctatatgctacaatcctaaagtgtcttagggaattacattttagatatgatgagtgcttacagggagcgaccgaggtggtcagcgatttatctgttgtctcagtcggaagtggtgttcataattacgctagagtgatagcagcatttttcgagagattcttcagaaagcatgatatcccgcttagcgccaattacgcgtctagagttgcccaatacctgatatctgccatgggttcatctgtagcttctgcagatgcttcatcatcatca

SEQ ID NO: 158 - DNA, 537 bp, Artificial Sequence
  Description of Artificial Sequence: Synthetic polynucleotide
ggtgctagttcgacaacgaccgccacatcggaatcaggaattactgcttcctcagttgcaactggagcagccgctgccatttctaagactgcagccggtagtagttctattacttacctagctcgctcgttttccagatcattagtgagttatttattgcaaagcgcagaattccattcggttttttacagtggaatttcgtctggtattgcttcgcatatagcctccaccgccggaacatctactgcagagtcactggacctcgctagcctcaaatctgtcatagcaacagcctgcggaaaagctatggctgctacaaattccgagggaggtcctcatgctttcgctaatagtctaggatccgccataaccgcggttttgatcgaaaacgctattttaacaagcgagaattacgattattttgcaaaagaattcgcccacatcttttcaatttctgcatcgaaggtagtatcagctactagtgcaaagtctgcaagtgaggccacaagtgcttcttggacggctgcatctcgtaca

SEQ ID NO: 159 - DNA, 537 bp, Artificial Sequence
  Description of Artificial Sequence: Synthetic polynucleotide
ggtgctagctccaccactaccgctacctctgaatccggaattacagcttcatcggttgccacaggagctgctgcagccataagtaaaactgcagcaggatcttctagcatcacctatttggccagatcatttagtaggtcattggtgagttatttgttacaaagtgccgaattccactccgttttctactctggaattagttcaggtattgccagtcatattgcttcgacagcaggtacgtctacggctgaatctttggacctggcttccctgaagtccgtgatagcaactgcctgtggtaaagctatggcggctactaactctgatggtggaccacacgcctttgccaattccctgggttccgccattacggccgttttgattgaaaacgctattcttacgtcagagaattatgattattttgctaaagaattcgcacacatattctccatttctgcatctaaggtagtaagtgccacctccgcaaaatctgcaagtgaagccaccagtgcttcgtggacagctgcgtcacgtaca

SEQ ID NO: 160 - DNA, 537 bp, Artificial Sequence
  Description of Artificial Sequence: Synthetic polynucleotide
ggtgctagctctactaccactgccaccagcgaatcaggcattacagctagcagtgtcgcgactggagcagctgccgcaatttccaagacagctgctggtagttcgtctataacctatctagcaaggtccttttcgagatcactagtttcctacttgctgcaaagtgccgaattccattccgttttttattccggaatcagctctggtatcgctagtcacatagcttccacggctggtacttctacggctgaatcgttggatttagccagtctcaagtcagtgattgccacagcttgtggtaaggccatggccgcaactaatagtgagggtggtccgcatgcctttgcaaattcactaggaagcgctattactgctgttttgatcgagaatgccattttgacctcagaaaactacgattacttcgcaaaggagtttgcccatattttcagtatttctgctagtaaagtcgtgagtgctacatctgctaagtccgcttctgaagccacatcagctagttggacagcagcttctagaaca

SEQ ID NO: 161 - DNA, 426 bp, Artificial Sequence
  Description of Artificial Sequence: Synthetic polynucleotide
ggtgctggcgctggagctggagtaggtgtgggcggtgcaggcggttacggtcagggttacggtgctggagctggagcaggagctggagctggagctggtgcaggtggagctggaggttacggccagggttatggagctggtgcagcagctgctgctggagctggtgctggtgcagctggtggctacggaggaggttcaggagcgggtgctggtggtgctggaggttatggtcaaggatacggtgcaggttctggagccggtgcgggagccgctgcagcggccggtgcatctgctggagccgctggtggctatggtggaggagctggagttggtgctggagctggcgctggtgctgcaggtggttacggccaatcatacggatcaggtgctggagcaggtgcaggagcaggtgctgctgctgccgca

SEQ ID NO: 162 - DNA, 366 bp, Artificial Sequence
  Description of Artificial Sequence: Synthetic polynucleotide
ggtggagctggtggcggtggacaaggcggacttggatcgggaggagccggacaaggttacggagctggtctaggaggtcagggtggagcctcagccgccgccgctgcagctggtggtcaaggaggtcaaggtggtcagggtggatacggtggattaggatctcagggagcaggtggagctggtcaactgggatatggtgcgggccaggaatcggctgccgcagcagccgctgccgcaggcggtgcaggtggtggtggtcagggaggtttgggtgctggcggcgctggtcaaggttatggagccgcaggtttgggtggacaaggaggagccggccaaggaggtggatctggagcagctgccgctgca

SEQ ID NO: 163 - DNA, 615 bp, Artificial Sequence
  Description of Artificial Sequence: Synthetic polynucleotide
ggtggttacggaccaggttcaggtcaacagggaccgtcacagcaaggaccaggacaacagggaccaggaggccagggcccatatggaccaggtgcatctgcagctgctgctgcggctggcggttatggtccgggatcgggtcagcaaggtcctggtggacagggaccttacggacctggatcttctgcagcagctgctgcagcaggcggcaatggcccaggttctggacagcaaggtgctggacaacaaggcccaggtcagcagggacctggagcatccgccgcggcagctgctgcaggtggttacggacctggttctggacaacagggtcctggtcaacagggacctggaggtcaaggtccttatggtcccggtgcatccgcagcagctgctgctgctggcggttacggaccgggatctggtcaaggtcctggccagcaaggcccaggaggacaaggtccctatggtccaggtgcatcagctgctgctgcagcagcaggtggttatggtccaggatcaggtcaacaaggtccaggtcagcaaggtccaggtcaacaaggacctggtggtcagggtccatatggcccgggagctagtgccgctgctgctgctgca

SEQ ID NO: 164 - DNA, 720 bp, Artificial Sequence
  Description of Artificial Sequence: Synthetic polynucleotide
ggtggatacggaccaggctatggacaacagggtcccggccagcaaggtccgggtggacaaggaccttatggtcctggtgcttcagctgcaagtgctgcatctggtggatatggtcctggttcaggacaacaaggcccaggtcaacaaggaccaggtggtcaaggtccatatggccctggagccagtgccgccgccgctgcagcaggtggatacggaccaggttcaggtcaacaaggtcctggacaacaaggtcccggtcaacaaggccctggacagcaaggaccaggcggacaaggcccttatggaccgggtgcttctgcagctgctgccgccgccggtggttatggtccaggatctggtcaacagggaccaggccaacagggaccaggtcagcaaggtccaggacagcaaggacctggacagcagggtcctggacagcaaggtccaggacaacagggacctggtcagcaaggcccgggccaacaaggtcctggtggacaaggtgcttacggacctggtgcctctgctgccgctggagccgcaggcggatacggtcctggatccggtcagcaaggccctggtcaacaaggcccaggtcagcaaggaccgggtcaacaaggacctggccagcagggccctggtcagcaaggcccaggacagcagggacctggtcaacaaggtccttatggtcccggagcgtctgctgccgcagctgcagca

SEQ ID NO: 165 - DNA, 696 bp, Artificial Sequence
  Description of Artificial Sequence: Synthetic polynucleotide
ggttcgggacctggtggttatggtccagagaatcagggcccctcaggtccgggtggttacggaccgggtggctccggatcctctgccgccgccgccgcagcggccgcttccggacctggcggatatggtcctggctcacaaggtccttcaggaccgggcggtagtggaggttatggtccaggcagtcaaggagcttcaggaccaggtggtcccggtgctagtgcagctgctgcagcggccgcagccgctgcatctggtccaggtggttacggacctggaagtcagggtcctagcggtcctggagcttatggtcctggtggtccaggttcttcagccgctgctgctgccgctgctgcatctggtcctggaggatatggtccaggctcccaaggaccttctggtcctggtgtctatggcccaggaggaccaggatcatccgctgcagctgcagctgccgccggaagtggccctggtggctatggtccagaaaatcagggaccttctggtccaggcggttatggacctggaggttctggatcatctgccgccgcagctgccgctgctgcctcaggaccgggtggatatggacctggatcccaaggcccgagtggtccaggaggatcaggaggatatggaccaggatcccagggaggttcaggaccaggagcttctgcagctgctgccgcagcggctgca

SEQ ID NO: 166 - DNA, 579 bp, Artificial Sequence
  Description of Artificial Sequence: Synthetic polynucleotide
ggttcagcaacatccagtactacaaccactacgaccgtgtcgaagtccgcagccgcagcagcggcagcagcagctgctgcttcatcagcttcctctgcctcgcgtgattctgataggtcaagcactgcagcagaggcttatgctagttcgtctgcctacgctagttctaacttcgagaactacttagcttcagatttgagcaattcagatgaattcgagagtgtctatggctcgctgtattctagtgctgacgctgcgtcgtacgcacgaagtagcgctgagtacgcgtcgaatactttaggattgtccaaagaaacatcgtacgccttagcatccgctgcggctaaagctgtttctgaatccggcagtggttcatcaagttacgctagagcttacgcagttgctaaatcaagcgccgtagtgttacaaaactcgggtgtacttagctcttcaaactcccgatcactcagtagtgccttcgccaaagcttttgcaagttcctccgcatcttcctatgcttcatatcaatcgcgaaacacaggcacatcaagagcaagttcagccggttccggagctgca

SEQ ID NO: 167 - DNA, 579 bp, Artificial Sequence
  Description of Artificial Sequence: Synthetic polynucleotide
ggttctgcaacctcctcaaccactacgactactaccgtatctaaatcagctgctgcagccgctgctgctgccgctgcagctagtagcgcatcaagcgcttcacgagattcggacagatcatcgactgctgcggaggcttacgctagttcgtctgcttatgcttcaagtaattttgagaactatttagcctcagacctcagcaactctgatgaattcgagtccgtctatggtagcgtatattctagcagtgacgccgcttcttacgccagatcttctgccggctatgcaagtaacacattgggtttgtccaaagaaacaagttacgctctagcctcggcggccgcaaaagccgtttccgaatctggttcgggatctagttcatacgctagagcatatgctgttgctaagtcatccgcagctgtgctgcaaaattcaggtgttctttcttctagcaatagccgttccttatcaagtgcctttgctaaagcctttgcttcttcgtctgcatcttcctatgcttcttaccagagtaggaataccggaacatctagagcatctagtgccggaagtggagccgca

SEQ ID NO: 168 - DNA, 579 bp, Artificial Sequence
  Description of Artificial Sequence: Synthetic polynucleotide
ggtagtgcaacaagcagcaccaccactacaactactgtctcaaagtcagctgcggcggccgccgctgccgcagcggctgcatctagtgcctcgtcggcatctagggactccgataggtctagtacaaccgctgaggcgtatgcgtcgtcctcagcttatgcttcatccaactttgaaaattacttggcttccgatctgtctaacagtgatgaattcgaatcagtgtatggtagtgtgtattcctcatctgatgcagcatcgtacgctcgtagcagcgcaggttacgcttctaatacccttggactctccaaggaaacctcttacgctttggctagtgcagctgctaaggcggttagtgagtccggttccggatcgagttcctatgctcgagcttacgctgtagccaaatcttccgcagttgtcttgcagaacagtggagtactctcatctagcaactccagatcgctgtcaagcgcattcgctaaggctttcgcttcatcatctgcctcgagttacgcctcttacaagtctagaaacactggtacttctcgcgcgtcaagtgcaggatcgggcgccgca

SEQ ID NO: 169 - DNA, 579 bp, Artificial Sequence
  Description of Artificial Sequence: Synthetic polynucleotide
ggttccgctactagttcaacaactaccactactactgttagtaagtctgcagctgctgcagccgctgcagcagctgccgcctcatctgcctcgtcagcctccagagattccgatagatcttcaacggcagcggaagcttacgcttcttcctcagcatatgcgtcaagcaatttcgaaaactatttggcttctgatctgtcaaattcagatgagtttgaatctgtctatggatcactctactctagttcagacgcagcatcttatgctagatcaagcgccggatatgcttcaaacaccctcggtctttctaaagaaacttcctacgctttggccagtgctgcagcaaaagcagtttcagagtccggtagtggtagttccagctatgccagggcctacgctgtggcaaaatcttcagcagtcgtattacaaaatagtggcgttctgtcaagctcaaacagtagatctctatccagtgcctttgcgaaagcctttgcttcttcatcagccagttcttacgctagttataaatctagaaataccggtacatctagggcatcctcagccggttcaggagccgca

SEQ ID NO: 170 - DNA, 579 bp, Artificial Sequence
  Description of Artificial Sequence: Synthetic polynucleotide
ggttcggcgacaagttcaactacgaccacaacaaccgtgtcgaagtctgctgcagcggccgcagcagcagctgcagctgcttcgagcgcatctagcgctagacgcgactctgacagatcttcctctaccgctgaggcttatgcttcttcgtctgcttacacctctagtaactttgaaaactacctggcatctgatctatcctcaagtgatgaattcgaatctgtctacggttctctttattcctcttcagacgctgctagctatgctcgttccagtgccgagtacgccagtaataccttgggactatccaaagaaacttcatatgctctggcatcagccgcagcaaaggctgtatcagaaagcggtagtggatccagctcgtatgcacgagcttacgccgtcgctaaatctagtgcagtagtacttcaaaattctggcgtactgtcgagcagtaattctaggtctttgtcctctgcattcgctaaagcatttgcttcctcatctgcttcttcctacgcaagctacaagagtaggaatactggcacatctagagctagttctgccggttcaggtgccgca

SEQ ID NO: 171 - DNA, 579 bp, Artificial Sequence
  Description of Artificial Sequence: Synthetic polynucleotide
ggttcagccacctctagtactacaactactactactgtatcaaagtctgctgcagctgcagcagctgccgccgctgccgcttcgagtgcatcctctgccagccgcgacagcgacagatcctcaaccgcggcagaagcttatgcatcatcctcggcctatgcctctagcaatttcgaaaattatctagcctcagatttgtctaattctgacgaatttgagagtgtgtacggttcgttgtacagctcagcagacgctgcatcctacgctagctcctcaagtgaatatgcctccaatactttaggtctttcaaaggagacatcctatgcattggctagcgctgctgctaaggcggtttcagaaagcggttctggatcttccagttacgctagagcctacgctgtagcaaagagttctgccgttgttttaagaaacagtggtgtgttaagtagcagcaactcaagatcgctgtcatccgcgtttgccaaagccttcgcctctagttccgcttcttcatatgcttcttacaaaagtagaaacaccggaacctcacgtgctagctcggccggcagtggtgcagca

SEQ ID NO: 172 - DNA, 579 bp, Artificial Sequence
  Description of Artificial Sequence: Synthetic polynucleotide
ggtagcgctacatcttcgacaacaactacaactaccgttagcaaaagtgcagccgctgctgctgccgctgcagcagctgcatcctctgcaagtagtgccagaagagattccgacaggtcatcgagtaccgcagaagcttacgcctcctcatcggcgtacactagcagtaacttcgaaaactacttggcttctgatctaagttcttcagacgagttcgagtctgtttacggaagtctgtattcttcttctgatgctgcttcctacgcaagatcatctgcagagtatgcttctaacactttgggcctgtccaaagagacgtcctacgctctggcaagcgccgctgcgaaggcagtttcggaaagcggttctggttcttctagctatgccagggcatacgctgttgctaagtcatctgccgtggttttgcagaattccggtgtcttgagctcctctaattctagatccttatcttctgctttcgcaaaagctttcgcctcttcatcagcttcatcctatgcttcttctaagagcagaaacactggaacttctagagctagtagtgcaggtagtggagccgca

SEQ ID NO: 173 - DNA, 510 bp, Artificial Sequence
  Description of Artificial Sequence: Synthetic polynucleotide
ggtagtgccagatcatctagcgctgctgcggccagcgccgctgctttctcatctttaagtagagccttaatttatcgccttcagcaaaaccaagactttatatacaccttcaactctattgaaacgtccgatgcagcaagggctataacatactcttctgctctggcagccgctaacgctatgggtgcaggctcgtccgcttcccaggctgtagccttcgctgcagctaaagccgctgaaggtgtccctataagaagctcttcatacgcttatgctgaagccatcactaacgcaattactcctcattttttagccctgcatctagtgaatagtgctaacgtcgatgcttttgcctctgactttacttcctcatttgcaagtgccacggcgtccgccgcgagcgcttcagcagctgctagttccgcagcatccgctgctgcagccgcaactgcatcatccagttctaccagtacatcaacaaaaactactagttcggccgcagcagcagca

SEQ ID NO: 174 - DNA, 525 bp, Artificial Sequence
  Description of Artificial Sequence: Synthetic polynucleotide
ggttctgccatttctagcagtgccgctgcagcgagtgcagctgccttttcttctagtctctctcgagccttgatttatagattgcaacagaaccaagatttcatttatacatttaacagcattgaaacctcagacgccgctagggctatcacctatagttctgcactcgctgccgcaaatgctatcggtgctggtagtagcgcatcccaggcggtggcctttgctgctgccaaggctgccgaaggagtaccaataagaagtagctcctacgcctatgctgaggctattacaaatgcaataaccccgcactttcttgcttcccacctggttaatagcgccaacgttgatgcttttgcgtctgattttacaagctcgttcgcatctgcaactgcctcggcagcctcagcatctgcagctgcagcctcatcagctgctagcgctgcatccgctgctactacaaccgcttcctcctctacatcaacttctactacgacaacctcttcgacagcagccgctgccgccgca

SEQ ID NO: 175 - DNA, 525 bp, Artificial Sequence
  Description of Artificial Sequence: Synthetic polynucleotide
ggtgcagctgccagctccagagctagagcacaagctgcagccgcatcctctgctgctgcgtcggcggcagcagcttccagtgcatttgcagaagaactggcatttttgctgtggcaatctcaggacttcatcagtgcttttggatctactgccagttctagcgaagcaaccgcattagctcgttcctcagtaatggcagctgcaagagccgttggagtagctgaggctgcttccgctattgcaagtgctgcggctagtgcagcagcaggtgtctcacacggatcgtccgctgttgcttacgctagagcaattgcctccgccgttgctagagcttttgcccaatttggtatattaactctcagtaatgccgctgcctttggacgccaattcgctagatcctttagctctagcgcagctgcttcggcagcttcagctgcatctgcttcggctgcgagcgcaaaaagcgctgctgctgccgctgcttcttcatccacgacttcaacgagtactacaaccacttccaca

SEQ ID NO: 176 - DNA, 525 bp, Artificial Sequence
  Description of Artificial Sequence: Synthetic polynucleotide
ggtgcagctgctagttcaagaactcgtgcccaggcagctgccgcgagttccgccgccgcaagtgcagctgctgcatcaagtgcattcgcagaggagttaacatttttgttacgacaaagcccgaactttatctcagcctttggttcaacggcttcaagttctgaagctacagctctggccagaagttccgcaatcgctgccgctcgagctgttggagttgcaggagctgcttctgccatagcttctgcagcagctagtgcagcggctggtgtgtcccatggttcttcagctgctgcctatgctagagccattgcttttgccgttgctcaagcttttgccccgtttggaatcctcacattggccaaagctgccgcttttgcttctcaattcgcgcgatcattttcttctagtgctgcggcgtctgctgcttcagccgcttctgcgagtgctgcctcggcgaagtcagccgctgctgcagctgcctcatcatcaactacatccacaagcaccactacaacatccaca

SEQ ID NO: 177 - DNA, 525 bp, Artificial Sequence
  Description of Artificial Sequence: Synthetic polynucleotide
ggtgctgcggcctcctcgagagctcgagcagaagcagctgcggcatctagcgctgctgcttctgctgctgccgccagctctgcctttgccgaggaacttacttttttactacgccaatcccctaactttatcagtgcttttggatccacggctagttcttcagaagcaaccgctttggcaagatcttctgcaattgcagccgctagagccgtgggcgtcgctggtgctgcctctgctatcgcatcagcggcagcgtctgccgctgctggcgtttctcacggatcaagtgctgccgcctatgccagggctatcgcctttgcagttgcgcaagctttcgcaccttttggtatactgactttagctaaggcagcagcctttgctagtcaattcgctagaagcttcagctctagtgctgctgcctccgctgcaagtgcagcatctgctagtgcggcttctgctaagtcggcagcagctgctgcagcatcgagttctaccactagtactagtactacgaccaccagtaca

SEQ ID NO: 178 - DNA, 540 bp, Artificial Sequence
  Description of Artificial Sequence: Synthetic polynucleotide
ggtgctgcgtctgccgccggtgcaagcagtgcagcagcagcatccgcctcggcggcagcagcgagcttcacacaaaatttgatttacagcttgcaagaatccgaaattttttattctgcattaaggagtattgcctcttccggtgaagccagtaacctggcatacttggcagctgagcgagctgcttatggagctggactagacggtattgcaagctcagttgcttcagctgctgcgagcgctttcgctaataccgctttaggttctggagcagccgcctatgcgaaggccctagcatatgctatagcccctgttttaactcgagccaatattattaccctttctaatgctgcctctttggctaccacatatgcaaagggattcgcatctagtgcagccagtgccgcggcctcagccagcgctgcttccgccgctgctgcaagctccgctgcctccgcttcctcagccgcagccgctgcggcggcttcttccagcactagtacaagtactacagtctctcgatctacagccgcagctgca

SEQ ID NO: 179 - DNA, 549 bp, Artificial Sequence
  Description of Artificial Sequence: Synthetic polynucleotide
ggtgctgcctccgcagcaggtgcagctggagcatcctcagctgctgctgcttccgcctctgctgcagctgcttcattcacaagaaacctgatatactctctccaagagtcagagattttctacagtgctttacgaagcattgctagctctggagaagcatcaaatcttgcttacttggctgcagaacgcgcagcatacggtgcaggtttggatggtatcgcaagttcagttgcctccgctgctgccagcgccttcgctaacactgcactgggttcaggtgctgctgcctatgcaaaagctctggcttatgctatcgctcctgtgcttactagagctaacattataacactgagtaatgccgcctccttagctacaacatacgccagaggctttgcctcgagtgccgcctctgccgctgcgagcgcttctgcagcatctgccgcagccgcttcatccgcagcgtccgcatctagtgctgccgccgctgcagcagccagctcctcaacaagcacttccacaacagtgtccagaagcactgcggcagctgca

SEQ ID NO: 180 - DNA, 549 bp, Artificial Sequence
  Description of Artificial Sequence: Synthetic polynucleotide
ggtgctgcaagcgctgcaggagctgctggagcttcctccgcagctgctgcttcagcctctgctgctgctgcatcttttacaagaaacttaatttactcccttcaagaatctgagattttttactcagctttgagatcaatcgctagtagcggtgaagcatcaaatctagcctatttggcagctgaacgagctgcatatggagctggactggatggtattgcttcctccgttgcttctgccgccgcttctgcttttgcaaacacagctttgggtagcggagctgctgcctacgctaaagcactagcctatgcaatcgccccagttttgactagagcgaatattatcactttgtcaaacgctgcaagcctcgctacaacttacgctagaggattcgcttcaagcgctgcctccgctgcggcttctgccagcgcagcttcagcagctgcagcctccagcgctgcttctgcttcttccgctgccgctgctgcagctgcttcttcatccactagcacctccacaacagtttctaggtccactgctgcagccgca

SEQ ID NO: 181 - DNA, 543 bp, Artificial Sequence
  Description of Artificial Sequence: Synthetic polynucleotide
ggtgctgctagcgctgctggcgcagccggagcttccagcgccgctgctgctagtgcctcggcagccgctgcctctttctctaggaacctgatatattcgctgcaagaatctgaaattttttatagcgccttgagatctatcgcctccagcggagaggcatcaaatttggcctatctagctgctgagagagctgcttatggcgcaggtctagatggaatagcttcatctgtcgctagtgctgctgcctctgctttcgcaaataccgcacttggtagtggtgctgccgcctacgcaaaagctcttgcatacgctattgctcctgttttaaccagagcgaatattattactttgtcaaatgcagcaagtttagcaacaacctatgccagaggtttcgcttcttcggcagcttctgccgctgcgtctgcgtccgccgcttctgcggcagcggcttcatctgcagctagcgcaagttccgcagctgcagctgcctcatcttcaacttctactagcacaactgtctccaggtccactgcagcagctgca

SEQ ID NO: 182 - DNA, 525 bp, Artificial Sequence
  Description of Artificial Sequence: Synthetic polynucleotide
ggtgcagcatcagctgctggagccgctggcgcctcatctgccgcagcggcgagtgcgtccgccgctgctgcttcatttacccgtaacttgatctactcacttcaggagtccgagattttctattcagcccttagatctatcgcgtcctcaggagaagcctctaatttggcatatttagctgcagagcgtgccgcttacggagctggtttggacggaatcgcttcttcggtcgctagcgcagctgcatctgcatttgcaaatacagctttgggatcaggtgccgctgcttatgccaaagccttggcatatgcaattgcacctgttcttaccagagctaacataattacgctgtcaaacgctgcaagcctagctactacatacgctaggggttttgcttcttctgctgcctccgctgccgctagtgccagcgcagcctctgcggcagccgccagttctgcagctagtgctagttcctcatctgctgctgctgcagcagcttcatcatctactagtactaaagctaca

SEQ ID NO: 183 - DNA, 507 bp, Artificial Sequence
  Description of Artificial Sequence: Synthetic polynucleotide
ggtgctggagccggcgctggagctggcgccggagcaggctattcggccggcgctggttacggtattggagctggagccggagtgggcgctggtgctggtgcaggcgcaggtgccggatctggtaccggtactggagccggatatggttacggatcttcaacccaatctagctccaccatttacgctgctacctaccagggtggttatggacgagttgcaggcctgggtgccggagctggtgcaggtgcaggtgcaggaggaggtgcaggtgccggagcaggtacaggtgccggagctggagcaggaataggtgctggttatggtgctggcgcgggttatggagccggagctggaaccggctccggagcaggtgccggtgcaggaggaggcgcagcagctggtgctggttcgggtgttggtgcaggctacggtgcaggagctggctatggagccggagccggagccggtggtggagcaggtgcaggagccggaagcggtgcttcagca

SEQ ID NO: 184 - DNA, 522 bp, Artificial Sequence
  Description of Artificial Sequence: Synthetic polynucleotide
ggtgctggatacggtgcaggtgctggtgcaggaggtggagccggagctggtactggatatggtggaggtgctggatacggcacaggctctggtgcaggctacggtgcaggagtaggatacggagcaggcgccggagcaggtggtggagcaggagccggagccggcggtggtactggtgccggagccggtggtggagcaggtgcaggctatggagcaggaactggctatggtgccggagctggcgccggtggaggcgcaggagccggagctggcgctggtgcaggagccggtgctggtgccggttcaggtgcgggtgcaggatacggagccggcgctggttacggtgctggcgctggagctggtggagttgccggcgctggagctgccggaggcgctggagcagcaggtggtgcaggagctgccggtggagcaggtgccgccggaggcgccggtgccggtgccggagctggttctggagctggtgctggtgctggtggtggtgctcgtgctggagccggagga

SEQ ID NO: 185 - DNA, 540 bp, Artificial Sequence
  Description of Artificial Sequence: Synthetic polynucleotide
ggtgctggagccggtgccggatatggagccggagctggttacggagttggtgccggaggcggcgctggcgccggtgcaggagctggtggcggagctggtgcaggcgctggtggaggtgctggagctggagccggatccggcgccggagcaggagcaggaagtggagctggtgctggagcaggtggaggcgccggtgccggtgcaggttcgggtgcaggagccggcgctggttatggcgcggacgcaggtgtaggtggtggtgctggtgctggaaccggttatggtggaggtgccggttatggttctggagctggcgcaggctcaggtgcgggagccggtgctggatatggagcaggagccggttccggaaccggagtgggattcgttgctggtacttctaatagagttgcatcaactacttatagtactatgtacgcaaccggttataatggtggagtcggtgccggagcaggtggaggagccctctctcgtctcttggccgctggttatggagctggtggtggaactgcaacaggtgca

SEQ ID NO: 186 - DNA, 522 bp, Artificial Sequence
  Description of Artificial Sequence: Synthetic polynucleotide
ggtgctggatatggcgccggagctggcgctggtgctggttccggagcgggattaggtgcgggcgcaggtgctggtttcggtgctggagctggcgccggtgtatcagcaggagcaggtgcaggtattggagcaggagctggtgctggtgtcggagccggagctggtgccggcttcggagccggagcgggcgcgggtgttggagctggtttcggcgccggtgccggtgctggtgtaggagccggtgccggtgcaggcgttggagctggagccggtgctggttctggtgcaggagtcggtgctggtgttggagcgggatttggtgctggcgtaggcgcaggagttggtgcaggcgcaggagcaggcgcaggcgtcggagctggagctggagtgggagccggtgcaggagccggtgtaggtgctggtgctggcgcaggagttggagctggtgccggagctggtgttggtgctggagcaggtgctggctttggcgcaggagtgggagcaggcgtcggagccggagca

SEQ ID NO: 187 - DNA, 474 bp, Artificial Sequence
  Description of Artificial Sequence: Synthetic polynucleotide
ggtattggtgctggcgccggtgcaggatccggagttggtgcaggagctggcgcaggtagtggaaccggaaccggtgcaggttacggttacggctcttcagcacagtctctctccactcgttattctggagcttatcaaggtagttacggaggtgccggtgctggagctggtgcaggtgcaggagccggtgctggtgctggttctggcgcaggagctggctccggaactggatatggtgccggatcaggtgctggtgccggtgctggtagcggttctggagccggtgctggcaccggcgctggatatggtgctggttcaggcgctggagttggcgttggagccggtgccggttctggttacggcgccggaggaggtgctggagccggagcaggagctggtggaggagctggagctggtaccggtggcggtactggagcaggtgctggtgctgtatacggtgcaggtgccggtgca

SEQ ID NO: 188 - DNA, 477 bp, Artificial Sequence
  Description of Artificial Sequence: Synthetic polynucleotide
ggtgctggactaggtgctggtactggcgccggtgccggagctggtgcttctgctggaacaggaacgggatatggtcttggcagatacgcccaaggtaccagtgtcacatactcctccacctacggtaatggttactacggaggtttgggagctggatctggaacaggtgctggaggtggtgccggtgcaggagctggatccgccgctggtgccggtgctggtgccggctcaggcgcaggtttaggtgctggtgctggagcaggtgcaggtgcgggctttggtgcaggtgctggtgcgggtgtcggagcaggagctggtgctggaatcggtgctggagcaggagcaggtgttggcgccggagctggagccggctttggcgctggagtaggtggtggtgctggtgctggttccggagctggtgttggtgccggagtgggagctggtgtaggagccggtgcagtggtaggagctggagca

SEQ ID NO: 189 - DNA, 540 bp, Artificial Sequence
  Description of Artificial Sequence: Synthetic polynucleotide
ggtgcctattctgcagctgctgccgctgcagctactgctacatccggcggagcccctggaggttatggcggttatggcccaggtattggtggtgcctatggtccggcttcttccaccggaacaggtagtggcagtggctcaggcgccggcgctgctggaggaggaggatctggcggtcttggttcaagtggtggaaatggtggtttgggaagcggaaacggaggttctggtgcatcagcagctgcatcggcttctgccgcgagctcatcccctggaagtggaggctacggtccaggacagggagccggattcggctctggctcggcagctgctggtggatctggcacaggctcaggtgccggtggtcctggatcaggaggctatggtggacctcaattttttgcatccaacacgttcgcctcagcctacggaggtcaaggtctattaggaacatctggatatggcactggtcaaggtggagcttctggaactggctcctctggtggcggcggttcaggttcaggaacgggatctaactca

SEQ ID NO: 190 - DNA, 525 bp, Artificial Sequence
  Description of Artificial Sequence: Synthetic polynucleotide
ggtgcttcttcggctgctgcagctgctgctgctaccgctacatcgggaggagctccaggtggatatggaggatacggtccaggcatcggtggtgcatttgttcctgcttccactacaggtactggctccggctccggttccggtgctggagctgcaggttcaggaggacttggtggacttggttcatccggaggaagtggaggactaggtggtggaaacggaggatccggagcctcagctgccgcttctgcggcagctgcttcttcatcacctggtagtggaggttatggacctggacagggagtaggatctggaagtggcagcggtgcagcaggaggatcaggaaccggttctggtgcaggaggtccaggatcaggtggatacggtggtccacaattttttgcatcggcctacggtggtcaaggcttacttggtacatctggatacggtaacggtcaaggaggtgcctcaggaacgggtagcggaggagtgggaggttcgggatcaggagctggttctaattca

SEQ ID NO: 191 - DNA, 699 bp, Artificial Sequence
  Description of Artificial Sequence: Synthetic polynucleotide
ggtggtgccggtagcggacaaggaggttacggtggacagggtggcttgggaggttatggccaaggcgctggagccggtgcagccgccgctactgctgctggaggtgctggatctggtcaaggagactacggtgaccagggaggcctgggaggatatggtcaaggatctggtgccggttcagctactgctcctgcagctggaggttcaggttttggacaaggtggattcggtaatagaggtggaaaaggtgcctatggacaatccgctggtgctggtgtcggcgctgcggccacagccgccgctggaggagcaggatcaggccaaggcggttatggtgaccaaggaggtttgggaggttacggacagggtgcaggagccggtgccgcatcggctgccgccggtggtggtgatggctacgaacaaggtggttacggtaaccaaggaggacttggcagttttggacaaggcgccggtgctggagctgccgctgcggcctccgccggaggtgccggatctggtcgaggtggatatggagatcagggtggtttgggtggttacggccaaggagctggtgctggagctgcttccgccgctgccggaggaggcgacggttatggtcagggctattatggcgatcaaggtggtagaggaggttatggtcagggttctggtgctggcagtgctacggcagctgctgca

SEQ ID NO: 192 - DNA, 834 bp, Artificial Sequence
  Description of Artificial Sequence: Synthetic polynucleotide
ggtggtgcaggtttcggtcaaggcggatacggtcagggtggctatggcaaccaaggaggtttgggatcctttggacaaggtgctggtgctggcgccgctgccgccgcatcagcaggtggtgctggtagtggaagaggtggatacggcgaccaaggaggtttaggtggttacggccaaggtgcaggagcaggagcagcagctgctgcagcaggaggtggagatggatacggtcagggaggttatggaaaccaaggaggcctaggctcattcggtcagggagccggagccggtgccgcagctgccgcctctgctggaggtgccggctcaggacgtggtggttatggacaaggaggttatggcaaccagggtggtttaggttcattcggacaaggagctggcgctggtgccgccgccgctgcatccgcaggtggtgcaggttctggacgtggcggttacggcgaccagggtggattaggaggttacggtcagggcgctggatctggtgccgctgctgctgcagccggaggaggtgacggttacggacaaggcggatatggtaaccagggtggactcggttcctttggtcaaggtgctggagctggtgctgctgccgcggcatcagctggtggtgccggatcgggtcgtggtggatatggccaaggtggatacggaaaccagggtggactaggatcttttggacagggagcaggagcaggtgcggctgccgctgcatcagctggaggagccggatcgggtaggggaggatatggagatcaaggtggtctgggtggctacggtcagggtgccggagctggtgctgcctctgcagctgca

SEQ ID NO: 193 - DNA, 507 bp, Artificial Sequence
  Description of Artificial Sequence: Synthetic polynucleotide
ggtggtggagatggctacggccaaggtggatacggtaatcaaagaggagttggatcctatggtcagggcgctggcgctggtgcagctgccacatctgccgcgggaggcgctggtagcggaagaggtggttacggtgagcaaggaggccttggaggttacggccagggagctggtgctggagcagctagtaccgctgcgggaggtggtgatggatatggtcaaggaggatacggtaaccaaggtggacgtggttcttacggacaaggatctggagcaggtgcgggagccgcagtagctgcagcggccggcggtgctgtttcaggccaaggaggttatgatggtgaaggtggtcaaggtggttatggtcagggatctggtgctggagctgcagttgctgccgcctctggtggaaccggcgctggtcaaggaggttacggctctcaaggttctcaagcaggttacggtcagggtgctggttttagagcagctgctgctaccgcggctgca

SEQ ID NO: 194 - DNA, 489 bp, Artificial Sequence
  Description of Artificial Sequence: Synthetic polynucleotide
ggtgcatatgcttatgcatatgctattgctaacgcatctcagattgcagcttccgttgcctcagctgttgcctcaagcgcatcagctgcggctgccgctgcatcgagcagtgctgcagccgctgctggtgcatcctcggcggctggagctgcatcctcttcgtccactaccacaacaactagtacttctagctctgccgctgctgcagctgcggcagcggcagccgcttcagcaagtggagcttcaagtgcgtctgctgctgcatctgcttctgctgccgcttctgctttttcctcagccctaattagcgatctacttggtatcggagtctttggaaacacctttggctctattggttccgcttcagcagcttcatcgatagccagtgctgccgcacaagctgccttaagtggattaggtttgtcctacctagcttctgcaggtgcatcagcagtggcctcggccgttgccggagtgggtgttggagca

SEQ ID NO: 195 - DNA, 492 bp, Artificial Sequence
  Description of Artificial Sequence: Synthetic polynucleotide
ggtgcttacgcgtatgcttatgctatcgccaacgctttcgccagtattttggcaaatacaggattactgtcagtttcgtcagcagcctctgttgcttcttctgtggcttcggccatagccacctctgttagttcatcttctgctgctgcagccgcttcagcttccgctgcagctgcggcaagtgcttcggcagcaagttcagcttcagcctcatcgtccgcaagtgctgcggccgccgcaggtgcctctgccgccgctggtgcggcatcatcggcgtctgcaagcgccgccgcctccgcatttagcagcgcgttcatatctgctcttctaggtttctcacaatttaactcggtgttcggttctattacatccgctagcttgggattgggaatcgctgctaacgcagttcagtcaggactagcgtcactaggtctaggtgctgctgcatcagccgctgcctctgcagttgccaacgcgggcttaaatggctca

SEQ ID NO: 196 - DNA, 534 bp, Artificial Sequence
  Description of Artificial Sequence: Synthetic polynucleotide
ggtgcttatgcttacgcgacggcaattgcttcagcgattggtaacgcactattaggtgcgggattcttgacagctggaaacgctagccagatagctgcttctgtagcaagtgctgtggcatcatcggcatcagccgccgctgcagcagccagttctagcgcggccgcagctggtgctagctctgctgctggagcagcttcatcctccagtacaaccactaccacatctacttcatcgtcggcagctgctgctgcagctgccgctgctgccgcatccgcttcaggtgcctcttctgcgagcgcagcggcttctgctagtgccgctgctagcgctttcagtagcgctttgatcggtgacttgttgggtataggtgtattcggaaataccttcggatctatcggtagcgcatccgctgcttcaagtattgcttctgctgctgctcaagctgcattgagcggacttggactgagttatcttgcttcagccggtgcctcagccgttgccagcgcagtcgccggagttggcgtgggagca

SEQ ID NO: 197 - DNA, 756 bp, Artificial Sequence
  Description of Artificial Sequence: Synthetic polynucleotide
ggtgcgggcgctggagctggtgccggcgccggagccggagcaggcgctggttccggcgcttctactagcgtctcaactagcagtagttcaggtagcggtgcgggtgcaggagctggttctggtgctggttctggagcaggtgccggatctggtgctggagccggtgcaggtgcaggtggtgcaggcgctggtttcggatctggtctgggtctaggatacggcgtgggcttatcttctgcacaagcgcaagctcaggcccaagcagctgctcaagctcaagctcaagcacaagcacaggcttatgccgctgcacaggctcaagcacaggcccaagcccaagcgcaggctgcagcagctgcagctgctgccgctgctgctggtgcaggtgctggtgctggcgctggtgctggtgcaggtgccggtgccggttccggagcttcgaccagtgtaagcacatcttccagctccggctccggtgctggtgccggagcaggatcaggtgctggttcgggtgctggtgcgggatcaggtgctggagcaggagctggtgccggtggtgctggagctggattcggtagcggacttggacttggatatggtgttggcttaagctcagcacaagcacaagctcaagcccaagctgctgcacaggctcaggctcaagctcaggctcaagcctacgctgctgctcaagcccaagcacaagcccaagcccaggcccaagctgcagctgccgctgctgccgcggccgccgca

SEQ ID NO: 198 - DNA, 756 bp, Artificial Sequence
  Description of Artificial Sequence: Synthetic polynucleotide
ggtgcaggtgcaggtgctggtgccggagcaggagcgggagctggagcaggttccggtgccagtacctctgtctcgacctcatcatcttctggaagtggtgctggagctggtgcgggatccggtgctggatctggtgcgggtgcaggaagcggtgctggtgctggcgccggtgcaggtggtgcaggagcagcttttggaagtggtttaggattgggttatggagttggattgtcctccgcacaggctcaggcgcaagcacaagcagctgcccaagctcaagctgatgctcaggcacaagcctacgcagccgcccaggctcaggctcaagctcaggcccaggctcaagctgctgcagctgccgccgcagctgctgctgctggcgctggagcaggtgcaggcgctggttccggagctggagcaggagctggatcgggcgcatctacctccgtctctacctcatcttcttcaggttctggagctggcgcaggagccggttctggagccggttcgggtgctggcgctggatccggagctggtgcaggagcaggtgctggaggagcgggtgccggtttcggaagtggacttggtcttggttacggagttggtctgagttctgctcaggcgcaagcccaagctcaagcagctgcacaagcgcaggctgacgcacaagctcaagcctatgccgctgctcaagcacaagcccaggcccaggcacaagctcaggcagccgcggccgccgctgctgcggcagccgca

SEQ ID NO: 199 - DNA, 756 bp, Artificial Sequence
  Description of Artificial Sequence: Synthetic polynucleotide
ggtgctggagccggcgctggtgctggatctggagctggtgcaggagccggttcaggtgcctcaacaagtgtctctacaagttcttctagtggttcaggtgctggtgctggtgcaggatctggagccggatctggtgctggcgcgggtagtggagctggcgcaggagctggtgcgggtggcgccggagctggcttcggctccggtttgggacttggttacggcgtaggtctttcttctgcacaagctcaagcgcaatctgctgcagcagctagagctcaggccgacgctcaggcacaagcatacgctgctgcacaagcacaggcccaggcccaggcacaggcacaagccgccgcagctgctgccgctgctgctgctgcaggagctggagcgggcgctggtgccggagcaggagctggtgctggagcaggttcaggagcatcaactagcgtttccaccagttcctcatcagcttctggtgctggtgctggcgccggtagcggagcgggttctggagccggtgccggttccggagcaggtgcaggagccggagctggcggcgccggcgcaggttttggaagtggtttgggtcttggctacggtgtaggattaagctcagcccaggctcaagctcaagcacaagccgctgcccaggctcaggctcaagctcaggcacaagctctcgccgctgctcaagctcaagctcaggcgcaagctcaagcccaagctgccgctgccactgcagcggctgctgctgca

SEQ ID NO: 200 - DNA, 582 bp, Artificial Sequence
  Description of Artificial Sequence: Synthetic polynucleotide
ggtcaaggaacggactctgtcgcaagcagcgcttcttcctctgctagtgcctcttcttcagccacgggaccagataccggatatcctgtaggttactatggtgctggacaagccgaagctgctgcttctgctgccgccgcagcagctgcttccgctgctgaggctgctacgattgccggtttgggttacggtagacagggacagggaactgattcatcagcctcttctgtttctaccagtaccagtgtcagttctttggcaacaggacctggttcgcgatatccagtgagggactatggagcagatcaagcagaggccgccgcatcagccgcagccgccgcttctgccgctgaggaaattgcttctttaggttatggtcgtcagggacaaggtacagatagtgtcgcttccagtgctagttcatctgcaagcgccagtagctcagccactggaccggatacaggttaccccgtaggttattacggagccggacaggccgaggctgctgcatcagctgcggctgccgctgccgccagtgccgctgaagccgctactatcgcaggtttgggatatggtagacaa

SEQ ID NO: 201 - DNA, 594 bp, Artificial Sequence
  Description of Artificial Sequence: Synthetic polynucleotide
ggtcagggaacagattcttcggcttcatcggtatccacctctacctctgtatcttcctctgctactggacctgatacaggttatcctgtcggatattacggcgctggacaggcagaagcagctgccagcgctgcagcggcagccgctgctagcgcagccgaagccgccacaattgccggacttggttacggcagacaaggtcagggaaccgacagctcggcctcttctgtatcaactagtacttcagtgagtagttcagctactggtccagatatgggttatccagtgggaaactatggagcaggacaagctgaagccgccgcttcagctgctgctgcagccgctgcatccgcagcagaggctgcgactattgcatctcttggatatggccgtcaaggacagggtactgattcatccgctagctcagtctctacaagtacctctgtctccagttctgcaactggtccaggttcacgttatcctgttagggattatggagctgaccaggccgaggctgctgctagtgccgcagcagcagcagctgctgcagcctctgctgcagaggaaatcgccagtctgggatacggtaggcaa

SEQ ID NO: 202 - DNA, 594 bp, Artificial Sequence
  Description of Artificial Sequence: Synthetic polynucleotide
ggtcagggcacagactccgttgcgagctcggcttcttcatctgcatctgcaagctcttcagcaacaggtcctgataccggttacccagttggatattatggagcgggtcaagcagaagctgcagctagtgccgcagcagccgccgctgcatccgctgctgaggcagccactattgcaggtttgggttacggacgacaaggacaaggtacagattctagtgcatctagtgttagtacctccacatctgttagctcttcagctacaggaccaggatccaggtatccagtcagagattatggagcagaccaagcagaggccgcagcctctgctaccgccgcagctgcagctgccgctagtgctgctgaagaaattgctagtcttggttatggacgccaaggacagggaacagacagtgttgcatcctctgcctcctcgtccgcttctgcatcatcgtcagccaccggtcctgatactggttatcctgtcggttactacggagctggtcaagccgaggctgcagcttcagccgcagcggcagctgctgcttcagccgctgaggccgccaccattgctggtctaggatatggtcgacaa

SEQ ID NO: 203 - DNA, 621 bp, Artificial Sequence
  Description of Artificial Sequence: Synthetic polynucleotide
ggtgtctccctatctagttctcaggctacatcggtggctagcgcaattagcagttccttgtatgcttttaactaccaagctagtgccgcttcatcagctgcggctcaatccagtgcccaaacagcaagtaccagtgctaagcagacggctgcgtcaacttctgcatccacagcggccaccagcacaacgcaaacagctgcaacaacctcagcctcaacagccgcatcgagtcaaacagtacagaaggcttctacatcaagtgccgcatccaccgcagcaagcaagagccaaagttcttctgccggctcttcaaggactacatctacagccgcagcctctgcaagcagctcttacgctttcgctcagtcgttatctcaatacttactgtcgtcgcagcagttcaccaccgcttttgcctcttccactgcagtggcatcctcccagcaatatgctgaggccatggctcaaagcgtggcaacgtcgttgggcttgggatacacttatgccagcgcactctcggttgccatggcccaagctatttctggagtcggtggtggtgcttctgcttactcatatgctacagccatttcacaggcaatatccagggctttgacatcttca

SEQ ID NO: 204 - DNA, 618 bp, Artificial Sequence
  Description of Artificial Sequence: Synthetic polynucleotide
ggtgtctctctttcttcttcgcaagctacttctgtagcttctgcaatcagcagctcattatacgcatttaattatcaagcttctgccgctagttccgctgcagcccagagctctgcccagaccgcaagcacatcagctaagcagaccgcggctagtacgtcagcatccacggctgctacatctaccacccaaacggctgcgaccactagcgcttctactgctgcctctagtcagacagtccaaaaagcctccacgagttctgcagcaagtacagcagcgtcaaagagccaatcttcttctgtgggtagttccacaacctcgactgcagcagcttccgccagttcttcatacgcttttgctcagtctttgtcccaatatttgttgagttctcaacaatttacaacggcttttgcaagttccaccgctgttgctagttcacaacaatatgctgaagccatggcccagagtgttgctactagcttaggacttggatacacctacacttcggccctgagcgtcgctatggctcaagcaattagcggtgtcggcggaggagcctctgcttactcctacgccactgccatttcacaggcaatttcaagagttttaacttcttca

SEQ ID NO: 205 - DNA, 618 bp, Artificial Sequence
  Description of Artificial Sequence: Synthetic polynucleotide
ggtatatccctgtcgtcaagtcaagctacttccgtggccagtgctataagttcttctctatacgcttttaactatcaggcttctgccgcttcatcggctgccgcacagtcatctgcgcaaacggcaagtacgtccgctaaacaaactgctgcttctacctctgcctctacagctgctacttcaacgacacaaacagctgccacaacctcggctagtacggctgctagttcgcagacagttcaaaaagcgtcaacttcttccgccgcctctaccgcagcatctaaatcacaatcttcctccgtgggttcaagcactacatctacagccgctgcgtcggcgtcctcttcgtatgcttttgcccaaagtttgtctcagtatctcttgtccagccaacaatttacaacagcttttgcaagctcaactgccgttgcttcatctcaacagtatgccgaagctatggctcagagtgtcgccacttcgttaggcttgggttacacttatacatccgctttgtccgtggcaatggcacaggccatatctggagttggtggtggagctagtgcttacagttatgctaccgccatttctcaggctatatcaagagtgctaacttcgtca

SEQ ID NO: 206 - DNA, 543 bp, Artificial Sequence
  Description of Artificial Sequence: Synthetic polynucleotide
ggtagcagtgcatacgactctcaattcagtgagagctcatctgcctcgtctgctgcagccagtgccttctcggaacagacctcctacgacatatcctcggatctttcttccgcatcaagtgctactgccgcagccgcgtcgtcgtctgcatatgaatcacaattctctgatgcttcttccggttcatcggcagcagctgcggcaagtagtcaacagaattcatacgatactgacgccttgtattctgcttcatctgctgcctccgcagctgcttctgcaagtgcatacgaactagagttttcagatgcatcttcatcgtctagtgctgtcgcagttgcatcttcacaacagggctcatacgatacctcctcagacttttctagtgctagttccgctgctgccgccgcagcttctgcttatgagtctaagttcttggatgcttcttcatctagctcggctgccgctgcagcaagttctcaacaatcatcatatgagacgagttcagacctcgtatctgctagttcagctgccgctgctgcggca

SEQ ID NO: 207 - DNA, 531 bp, Artificial Sequence
  Description of Artificial Sequence: Synthetic polynucleotide
ggtgcatcagcatatcagtcgcagttcttggatgcttcatcttcgtccaacgcagctgctaccacttcctcaagacaatccagttatgataccagttcagacttttcctcggcttcaatcgcagccgccgcagcggctagtgcctcatcatacgagagtcaattttcagatgcatccagttcctctaatgccgcagcggcagcctcgtcccaacaatcgtcttatgatacatcatctgatctggtttctgcagcttcggcgtctgcctacgaatcccagttcctagatgcttcctcaagtagtaatgccgccgctactacaagtagtcagcagtcctcctatgatacttcatcagatttctcttccgcttctattgctgctgctgccgctgcgagtgcttcatcgtacgagtcccaattctctgatgccagctcttcttccaacgccgccgctgcggcaagttcccaacagtctagctatgatacatccagcgatttggtgagcgctagttcagctgctgctgcagctgca

SEQ ID NO: 208 - DNA, 684 bp, Artificial Sequence
  Description of Artificial Sequence: Synthetic polynucleotide
ggtgcttcatcttacgagtcacaattttccgacgcatcttctagtagtaacgccgccgcggcagcttcgtctcaacagtcatcatacgatacctcttctgacttagtctctgcttcttctgccgcagctgccgccgctagtgcttcagcttatgaaagccagttcagcgacgcttcttcatctcgaaatgctgccgcagctgcatcgtctcaacaaagctcctacgatacttcatccgacttggtatctgcatcatccgccgctgcagccgctgcctcagcaagctcttacgaatctcaatttttagatgcctcttcctcgtctaacgctgccgctaccacttcatctcagcaatcctcatatgacacgtcatcagattttagtagtgcttccattgcggctgctgtagccgcctctgccagctcttatgaatctcaattttccgatgcctcttcatcgagtaaagccgcagctgcagcaagttcccaacagagttcttacgatactagcagtgatttagtttccgccagtagtgcagctgcagcagccgcgagtgcttctagttacgaatcacagttttctgatgcgagttcgagttccaacgcagccgccgccgcatccagtcaacagtcatcctacgatacctcaagtgacttttccagtgctaattccgccgcactggca

SEQ ID NO: 209 - DNA, 717 bp, Artificial Sequence
  Description of Artificial Sequence: Synthetic polynucleotide
ggtgctgcgcagaaacagccatcaggagagtctagtgttgccactgcaagcgcggctgcaacctcagtgacctcaggtggagcaccagttggaaagccaggtgtcccagcaccaatattttaccctcaaggtccgttacagcagggacctgcacctggaccttccaacgtccagcctggtacctctcagcaaggtccgatcggtggcgttggtggctcaaatgcgttttcgtcgtcattcgccagtgccttatccctaaaccgaggttttacagaagttatcagctctgcttccgcaacggctgttgcaagtgcttttcagaagggtctagctccatatggaactgccttcgctctgtcagcagcttccgcggctgctgatgcgtacaacagcattggatccggagctaatgcattcgcatatgctcaagcttttgctagagttctgtatccattggtcagacaatatggactatctagctctggtaaagcatctgcgttcgcctcagctattgcttcttctttctcttccggtacttctggacaaggaccgtccattggacagcaacaaccaccagtaactatttctgccgcctcggcctcagctggagcttcagctgcagccgtaggaggtggtcaagttggtcagggaccgtatggtggacaacaacaatccactgctgcctcagccagtgctgcagcagctactgccacatca

SEQ ID NO: 210 - DNA, 717 bp, Artificial Sequence
  Description of Artificial Sequence: Synthetic polynucleotide
ggtgctgcccagaaacaacctagtggtgagagttccgtagctactgcatctgcagcggccacttcagtgacttcgggtggtgctcctgtaggaaaacctggtgtacctgccccaatattttacccacaaggtccgttgcaacagggcccagcaccgggtccatcgaacgtccaacctggaacatcccagcaaggtccaattggtggtgtgggaggctctaacgcgttctcctcttcctttgcaagcgctctgtctttaaaccgaggtttcactgaagtgatatctagtgcttctgcaacagcggtggcttcagcgttccaaaaaggattagccccttatggcaccgcctttgcattgagcgcggcctctgccgctgccgatgcctataatagtatcggcagtggagctaatgctttcgcctatgcgcaagcattcgctagagtcctttacccacttgtgaggcagtatggtttaagttcgtctggaaaagctagtgcttttgcgtcagcaattgccagttcattctcttcaggtacttcgggtcaaggaccttctattggacagcaacaacctcctgtcacaatttctgctgcctctgccagtgctggcgcttctgcagcagctgtgggcggcggtcaggttggtcagggcccatacggtggacaacagcagagtactgcagcctctgcttcagcagcggccgccacagcaacttca

SEQ ID NO: 211 - DNA, 717 bp, Artificial Sequence
  Description of Artificial Sequence: Synthetic polynucleotide
ggtgctgctcagaagcaaccatcgggagaaagttccgtagcgactgccagtgcggctgcaacatctgtgacttccggtggtgctcctgtaggtaagccaggagtgcctgcacctatcttctatccacaaggtccactacaacagggtcctgctccgggaccatctaatgtgcaaccaggtacgtcccaacagggacctattggtggtgtgggaggaagcaacgctttttcttcctcatttgcatcggctctttccctaaaccgcggatttactgaggtcatttcttccgcttctgctactgcagtggcctctgcttttcagaaaggtcttgccccatatggcactgctttcgcgctctcagcggcttcggctgcagctgatgcttataattccattggtagtggagctaacgcttttgcatacgctcaggcatttgccagggtattatacccattggttcagcaatatggtctttcttcaagtgctaaggcttcagcttttgcttctgcaatcgcatctagcttttctagcggtacatctggacagggaccaagtattggacaacaacagccaccggttacgatttctgctgccagcgcttcagcaggtgccagcgcagccgcagtcggaggtggtcaggtcggtcaaggcccgtatggtggtcaacagcaatcaacagctgcatcagcatctgccgcagctgccactgctacctca

SEQ ID NO: 212 - DNA, 717 bp, Artificial Sequence
  Description of Artificial Sequence: Synthetic polynucleotide
ggtggtgctcaaaagcaaccatcaggtgaaagttctgtagctactgcttcggctgcagctactagcgttacctcagcaggtgctcctgtaggcaagccgggagtacctgcaccaattttttacccacaaggtcctctacaacagggtccagctcctggtccctcgaacgtccagccaggtacaagtcaacaaggtccaattggtggtgtgggtggaagtaatgccttcagtagcagtttcgcctcagccctctcattgaacagaggattcaccgaagtgatcagtagtgcctccgccaccgctgtggcatctgcttttcaaaaaggtctagctccttacggtacagcatttgctttatctgctgcctccgctgcagccgatgcctataatagcatcggatctggagctaacgcttttgcctatgctcaggccttcgccagagtattatacccattagtacaacaatacggactttcttcgagtgctaaggctagtgctttcgcatctgcaattgcatcatcatttagttcaggaacttctggtcagggtccatctaacggtcaacaacagcctccagttaccatatctgcagcatcagcttcagctggtgcctcagcagctgctgtcggaggaggtcaggtttctcaaggaccatatggtggacaacagcaatccacagctgcctctgcaagtgccgctgctgctaccgcaacttca

SEQ ID NO: 213 - DNA, 717 bp, Artificial Sequence
  Description of Artificial Sequence: Synthetic polynucleotide
ggtggtgcacagaaacaaccttctggtgaaagttccgtcgctactgctagcgctgccgcaacttcggttacgtctgctggagctcctggcggtaagccgggtgtaccggctcctattttctatcctcaaggtccgctgcaacagggaccagcgccaggaccttctaatgtgcaaccgggaacctctcaacaaggaccaatcggaggcgtaggtggaagtaatgctttttcttcttcattcgcctctgctctttctctcaaccgtggttttacagaggtaatatcatccgctagcgctaccgcagtggcaagtgcttttcaaaagggtcttgctccatatggaactgcttttgccttgtctgctgctagtgcggctgctgatgcttacaactccataggctcaggagccaatgcttttgcttacgctcaagcatttgctcgtgtattgtatcctctggtacagcaatacggactttcatcatccgcaaaggcctcagcctttgcctcagctatagcatcttcgttctctagtggtactagcggccaaggaccttcgattggccaacaacagccaccagtcactatttcagcagccagtgcttcagctggagcatctgctgcagcagtcggtggcggtcaagtaggtcagggaccatacggaggtcagcaacaatcaaccgctgcttccgcttctgctgcggcggcaacagcaacctca

SEQ ID NO: 214 - DNA, 726 bp, Artificial Sequence
  Description of Artificial Sequence: Synthetic polynucleotide
ggtggcgcacagaagcagccttcaggtgagagttccgtcgcaactgcttcagctgctgcaacatcagttacctctgccggtgctccagtgggaaaaccgggtgtacctgcacctattttttacccacagggtccactccaacaaggaccagcacctggaccttcatacgtgcagccagctactagccagcagggtcctattggtggagccggacgttctaacgcgttttcctcatcattcgccagtgctctgtcaggaaatagaggtttttctgaagttatctcttctgcgtccgcaacagccgtcgcatcggcttttcaaaagggtttggctccctatggtaccgcatttgcattaagtgcagcttcggctgccgccgacgcatacaacagtattggaagcggcgccaatgctttcgcatacgcgcaagcttttgccagagtgttgtaccctttggtacaacaatatggtttgtccagcagtgctaaagcatctgctttcgctagtgcaatcgcatcatcattttcttcgggcgccgcaggacagggtcagtcaattccgtatggaggacagcaacaaccacccatgaccatttcagccgcttctgcatctgcaggtgcttccgctgcagcagttaaaggaggtcaggttggacaaggtccatacggaggtcaacaacaatcaacggctgcatcggctagtgccgctgcaacgactgccacagca

SEQ ID NO: 215 - DNA, 735 bp, Artificial Sequence
  Description of Artificial Sequence: Synthetic polynucleotide
ggtggtgcacaaaaacatccatccggtgaatactccgtggcaacagcaagcgctgctgccacctccgtaacatctggaggtgcacccgtgggcaaaccaggtgtccctgcaccaatcttctatccacaaggacctttgcagcaaggtccagctcctggtccatcgaacgttcaacctggtacgtcacaacaaggtcctatcggaggtgtcggagaatctaacacgttctctagttcatttgctagtgcattgggaggaaacagaggtttttcgggtgtaatttcttccgcatctgccaccgcagtagctagcgcctttcaaaaaggcttggcgccttatggtaccgctttcgccctttctgcagcatcggcggccgctgatgcatataacagcatcggttccggcgcatctgcatcagcttacgctcaggcctttgctcgagtgttgtacccattgttacagcaatatggactatcatctagtgccgacgctagcgctttcgcatctgctatagcctcctcattctcaactggtgtagctggccagggtccgtctgttccttatgtaggacagcagcagccttctataatggttagtgctgcaagtgcttcagctgctgcatctgccgctgcggtaggtggaggtcccgtggttcaaggcccatacgacggcggtcaaccacaacaacctaatattgctgctagtgctgctgctgccgccaccgcaacatcctca

SEQ ID NO: 216 - DNA, 582 bp, Artificial Sequence
  Description of Artificial Sequence: Synthetic polynucleotide
ggttccttgggttaccagttagcattgcaaacagctaactcattgggaatccaaaatgctgcttcactggcctctgctgtggctcaagccgtgagcgccgtaggtgtcagggcaagctcatatgcctatgcaagcgccatttccaacaccgttggtcaattcttaaccagccaaggattgctttcgcaatcgaacgcatctgccttggcatccagttttgcctccgcctttgctgcatctgccgcttcagcaagcgcctctgccagtagttcttcttacgcccaatcatcggccgccgctcaatcgcagtctgcagcgagtgctttcacccgcgcagcatctgcagctgcaagccaagctagttctcagtctgcatcacaagccggttcgtatggaagaacaactacaacttctacttcgcaaagtggagcacaagcaggatcacaggccgcttcacaagcttcctctagtagctgggctgctgcttcggcctcagcgttcgcccagtcatctgcatcgtcgctcgcctcatcctcagccttctcctctgctttctcatctgcaagttcagcttctgcagta

SEQ ID NO: 217 - DNA, 582 bp, Artificial Sequence
  Description of Artificial Sequence: Synthetic polynucleotide
ggttcgttgtgttaccaactcgcgctgcagacagccaactctcttggtatacagaatgcagcctcgctagctagtgctgtctcacaggctgtttcagccgtcggcgttagagcttctagttatgcttatgcgagtgctattagtaatactgttggtcagtttttgatcagtcaaggtttattgagccagtctaatgctagtgcgttagcaagctcttttgcctctgcttttgcagctagcgcagcgtcggcctccgcttcagcctcgagttcatcctatgctcaatcctctgctgccgcacaatcccaaagtgcggcctcagccttcagcagagctgctagtgcagccgcgtctcaagctagtagccaatccgcctctcaagctggaagttatggacgcactactaccacttctacctccgaatctggcgcccaagccgcttctcaagctgcgagccaagcttcctcttcttcatgggcggccgcaagtgccagtgcctttgctcaatcttcagcttcctctctagcgtctagtagcgcgttcgcttcagcattttcttctgcaagttcaacgtctgcagta

SEQ ID NO: 218 - DNA, 546 bp, Artificial Sequence
  Description of Artificial Sequence: Synthetic polynucleotide
ggtaacgtgggctatcaattaggacttaaggtagcaaactcactgggccttggaaatgctcaggccctggcatccagtctctcacaagctgtttccgctgtgggtgtcggtgcatcttcgaatgcttatgctaatgcagtcagtaacgccgttggtcaagtcctggctggtcagggaatcttgaacgcagcaaatgccggaagcttggcttcatcgtttgcctcagctttgtctagttctgctgcttctgtcgcaagccaatctgcttcgcaatctcaagctgcaagtcaatcccaagctgcagctagtgcattcagacaggccgcatcacaatccgcctctcaatcggcaagtagagctggaagtcagtcatctacaaagactacttctacgtccacctcaggttcacaagcagatagccgatcggcatcttcttcagcatcacaagcttcagcctctgccttcgctcagcagtctagcgctagcctgtctagctcctcctcatttagttcggctttctcctcagcaacatcaatatccgcagta

SEQ ID NO: 219 - DNA, 546 bp, Artificial Sequence
  Description of Artificial Sequence: Synthetic polynucleotide
ggtaatgttggttaccagttgggacttaaagttgctaattcgcttggtttgggaaacgctcaggctttagcttctagtttgagtcaagcagtttccgctgtgggagttggagcttcttcaaatgcttacgctaatgcagttagtaatgctgttggacaagtactggccggccaaggaattttgaacgctgcaaatgccggttctttggcctctagctttgctagcgctctctcttccagcgcagcttccgtcgcaagccaatctgccagccaatctcaggcggctagtcagagtcaggctgccgcttccgcttttagacaggctgcttctcaatctgcatctcaatccgactccagagctggatcacaaagtagcactaaaactacatcgactagtacgtctggctctcaggcagattcaagatcagcttcatcctcagccagccaagcgtcggcctcagccttcgcccaacagagtagcgcgagtctatctagttcttcctcattttcttcagctttcagttctgctacttcgatatccgctgta

SEQ ID NO: 220 - DNA, 546 bp, Artificial Sequence
  Description of Artificial Sequence: Synthetic polynucleotide
ggtaacgtcggttaccaacttggtcttaaggtggctaactcactaggacttggaaatgctcaagcattggctagctctctgtctcaagccgttagtgctgttggagtgggcgcttccagtaatgcttacgctaacgctgtgtcaaatgcagttggtcaagtcctagcaggtcaaggaattctaaacgccgctaatgccggctctctcgcttcttctttcgctagcgctttgagttcaagtgctgcttccgttgcttcacaatcggcctctcaatcacaagcggcttcgcaatctcaagcggctgcctctgcattcagacaggcggcaagtcaatctgcttcccagtcggcctcccgtgcaggttctcaatcatccacaaagactaccagcacgtccactagtggtagccaagccgattcccgctctgcttcaagtagtgctagtcaggccagcgcgtcagccttcgctcaacaatctagtgcatctctaagttcgtcatcgtctttctctagcgcattcagcagcgctacatctataagtgcagta

SEQ ID NO: 221 - DNA, 528 bp, Artificial Sequence
  Description of Artificial Sequence: Synthetic polynucleotide
ggttcacaagccgcctctcagtcggcaagctcttctgcatcccaagcttcggcctcttcttttgctcaggcatcatccgcatctttggcagcctcttcctctttttcatcagccttttcctcagcaacttctctcagtgctcttggcaatgttgcttaccagttgggttttaacgtaggaacaaacttaggcttaacgaatgctgctggcttggctgcagccatctcacaggcagcatcctctgtaggtgtgggagcctcatctggtgcctatgctaatgctttgtcaaatgccgccgcccaatttttgagtgctcaaggtattttaaacacggtcaatgctggatcattagctagcagttttgcatcagcattgtcgtcagtagctgcctctgctgcagctcaagcaagttcacaaagccaagctgcaagtagtgcattttctagagctgcgagccagtcagcatcccagtcagccgcaagatcaggtgctcagagtagctcctctactaccacaacctctacatca

SEQ ID NO: 222 - DNA, 528 bp, Artificial Sequence
  Description of Artificial Sequence: Synthetic polynucleotide
ggttcacaagctgcaagtcagtccgctagtagctcggctagtcaggcttctgctagctcttttgcacaggcttcctccgcttcccttgcagccagttcatcttttagtagtgctttttcaagtgcaacatccttaagtgccttgggcaatgttgcttatcaactgggtttcgacgtcggtacaaacctaggtttgacaaatgcagccggtctagctgctgccttctctcaagctgcctcctcagtaggtgttggtggttcatctggagcttatgccaacgctttgtcgaatgccgcggcacaatttttgtcggctcaaggtatcttaaacacggtcaatgctggttctttagcctcttcttttgcatccgctctttcgtcagtcgcagcatctgctgctgcccaggccagttcacaatctcaagcagcttccagcgcgttctcacgagcagcaagtcaatcagcttcacagagtgctgccaggtctggagctcaatcttccagtagtacaacaactacttcctcctca

SEQ ID NO: 223 - DNA, 540 bp, Artificial Sequence
  Description of Artificial Sequence: Synthetic polynucleotide
ggtaatgttgcctatcagcttggatttaatgttgccaacaccttgggattaggtaacgctgcaggattaggtgccgcattgtcacaggctgtatcttcggtgggtgtaggagcctcttcaggtacttatgccaatgctgtttcaaatgctgtgggacaatttctcgccggtcaaggcattttgaacgctgcaaacgctgcgagccttgccagttcttttgctagtgctctaagtgcttcagccgcttctgttgctagctcgagcgcagctcaatcagcgagtcaatcccaagccgctgcatcggccttctccagagcagcatctcaatcggcttctcagtcggcagccctttctggtgcacagagctcatcgacaacaacgacaacatctacaagtggctcgcaggccgcctcacagagcgcatcatctagtgcaagtcaagcgtccgcttcgtccttcgcacaagctagttcggcttcactcgcagcttcgtcatccttttccagtgctttctcgtctgctaacaccttgtctgcatta

SEQ ID NO: 224 - DNA, 540 bp, Artificial Sequence
  Description of Artificial Sequence: Synthetic polynucleotide
ggtaacgtcgcctatcaattgggtttcaacgttgcaaatacattgggacttggaaacaccgcaggcctgggtgctgctctgtcacaagcagttagtagtgtcggtgtcggagccagttccgctacctacgcgaacgcagtttctaatgccgttggtcagtttttggctggtcagggtatcctaaatggcgctaatgctgcatcattggctagtagctttgccagcgccttgtctgctagcgcagcttctgtagcttcgtcgtctgccgcccaatctgcaacccaaagtcaagctgccgcttcggccttttccagagctgcttcacaatccgcttctcaatccgcagcaaggagcggcgctcaaagtagttccactacaaccactagctcaaccagcggatctcaggcagcttcacagtccgcatcgagttctgctagtcaggcttccgcttcgtctttcgctcaggctagtagtgctagtctggctgcgtcaagttccttttcttctgctttcagttcggccaatacactgagcgcacta

SEQ ID NO: 225 - DNA, 540 bp, Artificial Sequence
  Description of Artificial Sequence: Synthetic polynucleotide
ggtaacgtggcttatcaacttggtttcaacgtcgcaaacacacttggacttggaaatgctagcggattgggtgcagctttgagccaagccgtttctagtgttggtgtgggtgcatcttctggtacttatgcgaatgctgtttcaaatgctgtgggccagttcctggcaggccagggtattttgaatggtgctaatgctgcttctttggcttcttcattcgcttcagcattgagtgcttcagccgctagtgtagcttcatcatctgctgcgcaatcagcatcacagtctcaagctgccgcatcagcattttccagggctgcatctcaatctgcatcccagtcggcagccaggagcggtgctcaatccagcagtacgaccacaacttcttccacgagtggtagtcaagccgcttcccaatccgcatcatcctcggctagccaggccagtgcttcctcctttgctcaagcctcctctgcctccttagccgcttcaagtagtttttcgagtgtgttttccagtgcaaacacgttgagcgctcta

SEQ ID NO: 226 - DNA, 540 bp, Artificial Sequence
  Description of Artificial Sequence: Synthetic polynucleotide
ggttcattagcatcttcattcgctagcgcattatcggcatccgcagcatccgtcgcaagttctgcagcagctcaggctgcaagtcagtctcaagccgcagcctctgcattctctagggctgcctcccaatcagcttctcagtctgcagcaagatctggcgctcaatcatcctcgaccactaccacaaccagtaccgctggatctcaagctgcttctcaatttgcatcctccgctgcatcacaagcctcagcatcgtctttcgcacgagcttcctccgcctcattagcagcaagcagcagcttttcgagcgctttcagctccgcaaattccctatcagctttgggaaacgtaggttatcagctgggctttaacgtcgctaacaatcttggtataggaaatgcagctggtcttggaaacgcactgtcacaagccgtgagtagtgtcggcgtcggagcgtccagttcctcatacgccaatgctgtcagtaatgctgttggtcagttgttagccggacagggcattctaaatgccgctaacgca

SEQ ID NO: 227 - DNA, 540 bp, Artificial Sequence
  Description of Artificial Sequence: Synthetic polynucleotide
ggttcattggcatcttcattcgcttccgccttatctgcttctgcagcctcggttgcaagttcagccgccgcccaagccgcatcacagagtcaggccgcagcatcagctttcagcagggctgctagtcaatctgccagtcaaagcgcagccagatctggcgcacaatcaatttccacgacaaccactacatcaactgccggcagtcaagcagccagtcagtctgcatcatcagcagcttcccaagctagtgcctcatcattcgcgcgagcatctagcgcatcactagctgcatcgtcatcattctctagtgccttcagtagcgctaactctctatcagctctgggtaatgtaggctatcagttgggattcaatgttgccaacaatcttggtatcggtaatgcagcaggtctaggaaacgcattatctcaggccgtcagcagtgttggagtaggtgcctcttcttctacgtatgcaaatgctgttagcaatgctgttggacaattcttggcaggacaaggcattttgaacgcagctaatgca

SEQ ID NO: 228 - DNA, 540 bp, Artificial Sequence
  Description of Artificial Sequence: Synthetic polynucleotide
ggtagtctggctagctcctttgctagtgctttatctgcgtcggccgcatcagtggcctcatccgcagcagcacaggctgcttctcaaagtcaggccgcggcatccgcattttcacgtgctgcgtctcaatctgcatcacagtccgcagcaaggtcgggagcacaaagtagttcaacaactaccacaacttctaccgctggttcgcaggccgcatcccaattcgcatcttcagctgctagccaagcctctgctagttcattcgcgagggcatcatcggcctcactggctgcatcatcttcgttctcttctgcattttcttccgcaaattcactgtcggctctgggtaacgtcggttaccaattgggcttcaatgtagctaataacttgggaatctcaaatgccgcaggattgggtaacgctttatcacaggccgtttcttccgtcggagtaggcgctagttcttcctcttatgccaacgcagtttccaatgcagtgggtcagtttttggctggacaaggtatcttaaacgcagctaacgca

SEQ ID NO: 229 - DNA, 540 bp, Artificial Sequence
  Description of Artificial Sequence: Synthetic polynucleotide
ggttccctagcatcatcttttgcttctgccctgtctgcttctgctgcttcagttgcttcatctgcggccgcacaagcggccagccaaagccaggcagctgctagtgctttttctagagctgcttcacaatccgcttctcagtctgccgcgagatcaggcgcccaatccttttcaacaactacaacgacttcaaccgctggatcacaagcagcttctcaatcggccagtagcgcagctagtcaagcctctgcatcctcctttgctagagcatcgagtgcttcattggctgcatcaagcgcattctcttcggcattctcgtccgctaattctttaagtgccttgggaaatgtggcataccagctaggtttcaatgttgccaatacactgggaatcggaaatgccgcaggtcttggcaatgctctgagccaagctgtttccagtgtaggcgttggcgcatcttccagcacctacgctaatgctgtctccaacgctgtgggccaattcttagccggccaaggagtactgaacgcgggtaacgca

SEQ ID NO: 230 - DNA, 540 bp, Artificial Sequence
  Description of Artificial Sequence: Synthetic polynucleotide
ggtaacgttggttatcaattaggtttcaatgtggccaatacgctcggaattggaaacgctccaggattaggtaacgctttgtctcaagcagcctcctctgtaggtgttggagctagttccagtgcttacgctaacgctgtatctaatgctgtgggccaattccttgcgggtcaaggagttttaaatgcaggaaacgcaggtagtctggcttcttcatttgctaacgctctaagcgcttccgcggcaagtgtcgcatcaagcgcagcagcccaaagtgcatttcaaagtcaagctgccgcaagcgctttttctcgagctgcttcacaaagtgcttctcgtggtgcggctcgttctggagctcaatcttcttcaactacaacaactaccagtacgtcaggttcacaggccgcttcacaatctgcatcctcagctgccgcccaagctagtgcatcctccttcgctcaagcctcgtctgcttccttggcagccagttcagcattctcctctgcatttagttctgcaaatagtctgagtgctcta

SEQ ID NO: 231 - DNA, 540 bp, Artificial Sequence
  Description of Artificial Sequence: Synthetic polynucleotide
ggtaatgttggttatcagttgggcttcaatgtcgctaacacgctcggaataggtaacgcaccaggacttggaaacgccttatcccaagcggtatctagtgtaggtgttggtgctagtagttccgcctatgctaatgctgttagtaatgccgtgggacagtttttggccggacaaggagttttgaatatcggtaatgctggttcgttggcctcttcattcgccaatgctctgtctgcaagcgctgcttccgttgcaagctcagctgcagcccagtcagcctctcagagccaggcagctgcaagtgcattctccagagccgcatcacaatctgcttcgcgaggagcagcacgttcgggagctcaaagcagttccacaactacaacaacttctacatccggttcgcaagctgcttcccaaagcgcatcaagtgctgccgcccaggcctccgcgtccagttttgctcaagccagctcggcttcactcgctgcctctagcgctttttcctctgcctttagcagcgcaaactcactcagtgcgtta

SEQ ID NO: 232 - DNA, 540 bp, Artificial Sequence
  Description of Artificial Sequence: Synthetic polynucleotide
ggtaacgtcggataccaactaggtttcaatgtggctaataccttaggaatcggaaacgccccaggattgggaaacgctttgagtcaggctgtttcatctgttggagttggtgcatcatcatctgcctatgctaacgcagtcagcaatgctgtaggacagtttttagctggccagggagttcttaatattggaaacgcaggtagtctggcatcatcgtttgccaatgccttgtctgcatctgccgcctctgtggcttcttccgctgccgcacaaagcgcttcacaatcccaagccgccgcgtcggccttctcaagagccgccagtcaatccgcttctagaggtgctgcaagatcaggtgcccaatcttcgtcaactactactaccacttccactagtggatcacaggcagctagtcaatcagcatcgtcggctgctgcacaagccagcgcttcgtctttcgcccaagctagctccgcttctctcgcagcctcatccgctttttcgtctgcattctcttcagcaaattctttgtcggcacta

SEQ ID NO: 233 - DNA, 540 bp, Artificial Sequence
  Description of Artificial Sequence: Synthetic polynucleotide
ggtaatgtcggctaccagttaggattcaatgttgctaacacattgggtatcggaaacgcacctggtttaggaaatgcattatctcaagcagtttcgagtgttggagtgggagctagctcaagagcttacgctaatgcagtttctaacgcagtgggacaattccttgctggacagggagtcttgaatgtcggcaacgctggctccttggcttcatcgtttgcaaatgctctttcggccagtgcagcttctgtggccagtagcgctgctgctcaatcggcttctcaatcacaggcagccgcctcagctttctcgagagctgcttcccaatcagcttccagaggagctgctagaagtggtgcacagtctagttcaacaactactacaacgagtacatctggctcacaagccgcctctcagtccgcttcctccgctgccgctcaggctagtgcttcatcatttgcacaggcgtcctctgcttctctggctgcgtcctcagccttctcatccgctttttcatccgcaaattctttgtcagcttta

SEQ ID NO: 234 - DNA, 540 bp, Artificial Sequence
  Description of Artificial Sequence: Synthetic polynucleotide
ggtaacgtgggctatcagcttggttttaacgtcgctaacacattaggaataggtaacgcgccaagtttgggaaacgcactgtcacaagctgtctcttctgtaggagttggagcttcctcttcagcatacgctaacgcagtttccaacgctgtcggtcagtttctagctggtcaaggtgttttgaatgctggaaatgctggttctttggcctctagttttgctaatgcactgtcggcttcagccgcctctgttgcatccagcgctgctgcccagtcggcatttcagtcccaagccgccgcctcggctttttccagagcagcaagtcagtccgccagtcaatccgccgctcgttctggagctcaaagttcttcaacgaccacgactaccagtacatccggatcccaagcagcttctcaatctgcaagttcggctgccgcacaagctagtgccagcagtttcgcacaagcatcgtctgcctctctagcagcgagctcagcattctcctccgcttttagttcggcaaacagtttaagtgcatta

SEQ ID NO: 235 - DNA, 540 bp, Artificial Sequence
  Description of Artificial Sequence: Synthetic polynucleotide
ggtaatgtgggttatcagctaggttttaatgttgctaacacattaggtattggaaacgcaccaggacttggtaatgctttgtcacaagcagtatcttccgttggagtaggtgcatcttcatctgcttatgctaacgctgtgagtaatgctgtaggtcagttcttggccggacaaggtgtattgaatattggtaacgcaggttcgttagcctcatcctttgcgaatgctttatcagcttctgccgcatctgttgcttctagcgcagcagcacaatctgcctcccaatcccaggctgcagcttcggcattttcaagagcagcctcccagagtgcttctcgaggtgctgctagatccggagcccaatcttctagcacgactactaccacaagtacttcaggaagccaagcagcctcacaaagtgcctcgagcgccgccgctcaagcatctgcatcttcctttgctcaagcttcgtcagcctcactagctgcttcatccgcattctcatctgccttcagttcagccaatagtttgagcgctcta

SEQ ID NO: 236 - DNA, 540 bp, Artificial Sequence
  Description of Artificial Sequence: Synthetic polynucleotide
ggtaacgttggttaccagttgggattcaatgttgctaacactttgggtatcggaaacgctccaggactaggaaacgctttgtcacaggccgtctcttcagtaggagtcggtgcgtcctcatctgcttacgcaaatgcagtctcaaacgcagtcggacaattcttggctggtcaaggagttcttaacgccggtaatgcaggaagtctcgccagttctttcgccaatgccttatcagctagtgctgcaagcgtcgcaagtagcgcagctgcccaatcggctttccaatcacaagccgcggcaagtgcattctctagagcggcctcacagtcagccagtcagtctgctgctcgctcgggtgctcaatcttcttctactactacaaccacgtctacttccggtagtcaagcggccagccagtctgcttcgtctgcagctgctcaggcgagtgctagtagttttgcccaagcgagtagcgcttcgttagccgcatcttctgcctttagcagtgctttctcctcagcgaactccctttcagctcta

SEQ ID NO: 237 - DNA, 540 bp, Artificial Sequence
  Description of Artificial Sequence: Synthetic polynucleotide
ggtaacgttggttatcaattgggttttaatgtggcaaacacactcggcataggaaacgctccaggtttgggaaatgcattatctcaggccgtatcttccgttggtgtgggtgcatcctccagtgcatacgctaatgctgtctctaacgcagtaggtcagttcctggctggtcagggtgtcttaaacattggtaatgcaggttcattggcttcctcgttcgccaacgccttgtcagctagcgccgctagtgtcgcgtccagtgctgctgcccaaagcgcatcacaatcacaggcggctgcatccgctttctcaagggcagcttctcagtctgcatctagaggtgctgcacgttctggtgcacaatcctcttccacaacaacaactactagtacatccggatcccaagctgcttcacaatccgcatcttcagccgccgcccaagcatcagcttcttcctttgcccaagctagtagcgcttctttagctgcgtcgtctgcttttagttcggctttcagcagtgcgaattctttatctgcacta

SEQ ID NO: 238 - DNA, 540 bp, Artificial Sequence
  Description of Artificial Sequence: Synthetic polynucleotide
ggtaatgtaggataccaattaggtttcaacgtcgctaatacgctaggtattggtaacgctccaggcttgggaaacgccctgtcccaagccgtttcttcggtaggagtaggagcctcatctagagcatacgcaaacgccgtaagtaatgcagttggtcagttcttggccggtcaaggtgttctgaatgccggaaacgcaggaagtctcgcttcgagtttcgccaatgctttgtctgcctctgctgcctctgttgcgagttcagctgcagcccagtctgccagccaatctcaagctgcagcttccgcctttagcagagctgcatcacagtcagcatcccaatccgcagccagatcaggtgctcaaagctccagtaccactacgactacttcagcctccggatctcaagccgcatctcagagcgccagtagcgctgccgcgcaagctagcgcctcttcatttgctcaggcctcaagtgcctcccttgccgctagctcggccttttcttctgctttttcaagtgctaactcgctgtctgcgtta

SEQ ID NO: 239 - DNA, 540 bp, Artificial Sequence
  Description of Artificial Sequence: Synthetic polynucleotide
ggtaacgttggttaccaattgggtttcaacgttgctaacaccctgggtataggaaacgctcctggtcttggtaatgctctctcccaagctgtatcgtcggtcggagtaggagcttcatcaagtgcctatgcaaatgcagtctcaaatgctgtcggacaattcttggcaggtcagggcgttcttaatgcaggtaatgccggatcgttggccagcagcttcgctaacgctctttccgcttcggccgcttctgtggcatcctctgccgctgcacaaagtgcctttcaatcacaagcggccgctagtgcatttagtcgagctgcttctcagagtgcgagtcagtcagctgcaagaagtggtgctcagtcatcttctactactacaactacgtctacttcaggctctcaagctgcctctcagtccgcatcgtctgctgccgctcaagcatcagcgagtagctttgcgcaagcatcatccgcgtcacttgctgcctcaagtgcttttagtagtgccttctcttccgctaattcattgtccgcctta

SEQ ID NO: 240 - DNA, 540 bp, Artificial Sequence
  Description of Artificial Sequence: Synthetic polynucleotide
ggtagtcttgctagctcttttgcatccgctctttcagcttcagctgcatcagtggcaagttctgccgctgctcagagtgcttctcaaagtcaagctgccgcttcagccttcagcagggctgcttcacaatcagcctcacaaagcgcagcaagatcaggtgcccaatctagtagtaccaccacgactacatctgcttccggttcacaagcagcttcgcagtctgcttccagtgccgcaagtcaagcaagtgcctcgtcattcgctcaagcgagctctgcttcgttagctgcttcatctagcttttctagcgctttttcatcagctaattcgttgtccgctctgggaaatgttgcttaccagctgggatttaatgttgctaacacacttggaattggaaatgctccgggactgggcgcagccttatctcaagcggtttccagcgttggtgtgggtgctagtagcagtacctatgcaaacgtggtcagcaatgctgttggtcaattccttgctggacagggagttctgaacgctgctaatgca

SEQ ID NO: 241 - DNA, 540 bp, Artificial Sequence
  Description of Artificial Sequence: Synthetic polynucleotide
ggtagcttggcaagctctttcgcctcagctctgtccgcatccgctgcttcagtcgctagctcagcagctgcacagagtgcttctcaaagtcaagctgcagcctctgccttcagtagagccgcttcgcagagtgcatctcagagtgccgcgaggtctggagcacaatcttccagtactacaacaactacgtctgcttccggatcacaagccgcctcgcaatccgcctccagtgctgcgtcacaagcttcagcttcttcatttgcacaggcctcctctgcatctctcgcagcttcctcttcgttctcttcagcattttcttcggctaacagtttgtctgctcttggtaacgtcgcatatcaactcggtttcaacgttgctaacaccctaggtattggtaatgcaccaggactcggtgccgccctttcacaggcagtgagctctgtcggcgtcggtgcatcatcaagtacttacgccaatgtcgtgtctaatgctgtgggacagtttttagcaggacaaggtgtcctgaatgctgcaaatgca

SEQ ID NO: 242 - DNA, 540 bp, Artificial Sequence
  Description of Artificial Sequence: Synthetic polynucleotide
ggttctcttgcttcgagctttgctagtgcattgtccgctagcgctgcatccgtcgcttcttctgctgcagcacaatctgcatcacaaagccaagctgctgcttctgctttttctagggctgcttctcaatcggctagtcagtcagctgctagaagtggagctcaatcttcgtctaccacgactactacctcagcatccggtagtcaagcggcctcacagtccgcatcatcagccgcttcccaagcttccgcatcgtcattcgcccaggcctcgagcgcctctttggccgctagcagttcgttttcttccgcattctcctccgcaaactctctaagtgctcttggaaatgttgcataccaattgggatttaatgttgctaacactttgggaattggcaatgcgccaggattgggagctgcattatctcaagcagtgtccagtgtcggtgtgggagcttcatcaagcacttatgctaacgtggtttctaacgcggtaggccaatttctcgcaggtcaaggtgttttgaatgctgctaatgca

SEQ ID NO: 243 - DNA, 540 bp, Artificial Sequence
  Description of Artificial Sequence: Synthetic polynucleotide
ggttctctggcctcgagctttgcctccgcattaagcgcttccgcggcttcagtggcttctagtgccgccgcccagagcgcttcccagagccaggccgctgccagtgctttttcgagagctgctagccaatcagcatcacagtccgcagcgagatccggtgcacaatcttctagtactactaccactacctctgcaagtggatctcaagccgcttcccaatcggcctcttctgctgccagtcaagcatcagcgtcgtcttttgcccaagcttcctctgctagtttagcagcctcgagcagcttctccagcgcattttcttctgctaattcactttcagctttgggtaacgtagcctatcaattgggttttaacgttgctaacacacttggaataggtaacgcacctggtctgggtgcagccctgtctcaagctgtgagctccgtgggcgtcggtgcctcgagttcaacctatgcaaacgtagtatctaacgccgttggacaattccttgccggtcaaggagtacttaacgcagctaatgca

SEQ ID NO: 244 - DNA, 540 bp, Artificial Sequence
  Description of Artificial Sequence: Synthetic polynucleotide
ggttctctagcttcttctttcgcgtccgctctcagtgcttcggccgccagtgttgcaagctcagctgccgctcagtccgcaagccagagccaggctgcggcaagtgccttttctcgagctgcttcccaatctgcaagtcagagtgctgcacgaagtggagcacaatcatcgtctactaccacaactacttctgctagtggatcccaagctgcttcacaatcggctagttcggctgcatctcaagccagtgcgtcctcattcgcacaggcctcgagcgcttcattagcggcatccagctcattctcgtctgcatttagctccgctaatagtctgtctgctcttggaaatgttgcctaccaacttggattcaacgtagccaatacactgggaataggcaacgctcctggcctcggtgctgctctgtcacaagcagtttctagcgtaggtgtaggtgcttcttccagcacctatgctaatgtggtgtcaaatgctgttggacaattcctggcaggacaaggtgtgctgaacgccgctaatgca

SEQ ID NO: 245 - DNA, 540 bp, Artificial Sequence
  Description of Artificial Sequence: Synthetic polynucleotide
ggtagcctcgcatcttcctttgctagcgctctgagtgcctcggctgcaagtgttgcatcaagtgcagccgcacagtctgcttcgcaaagccaagctgcggcctctgcattttccagagcagcatcacaatccgctagccaaagcgctgctaggtccggtgcacaatcatcttcaactactaccaccacttcagcttccggctctcaagctgcatcacagagcgccagttccgccgcctcgcaggcttccgcatcatctttcgctcaagcctcgtccgcttccctagccgctagctcatccttctcaagtgctttttcctccgccaattctctttcagctttaggaaacgttgcttaccaattgggttttaacgtagccaacacacttggcatcggaaacgcacctggtttgggtgctgctttaagtcaagccgtttccagtgtcggtgtgggagctagttcgagcacgtatgctaatgtggtttcgaacgccgtcggacaatttttagcgggacaaggtgttttgaatgcagctaacgca

SEQ ID NO: 246 - DNA, 540 bp, Artificial Sequence
  Description of Artificial Sequence: Synthetic polynucleotide
ggttcattagcatctagctttgcatctgcactctccgcttcagctgcctcggtggcctcgtccgctgcagcccagtcagctagtcaaagtcaggctgcagcttctgccttttctagggctgcatctcagtcgggtagccagagtgccgctcgatctggtgctcaaagctcgagtactaccacaacaacaagtgctagtggatctcaggccgcgagtcaatcagcatcgtctgccgcttcacaagcttcggcttcttcttttgcgcaagctagctcggcttccttggctgcttccagctccttcagctccgcattttcaagcgctaatagtctctcggctttaggaaatgttgcctatcaactcggtttcaatgtggctaacactttgggtataggtaatgctccgggattgggagcagctttatcgcaggccgtctcttctgtaggagtaggcgcttctagctctacatacgctaacgttgtcagtaacgcagttggtcagtttttggctggacagggagtgttaaatgctgctaatgca

SEQ ID NO: 247 - DNA, 540 bp, Artificial Sequence
  Description of Artificial Sequence: Synthetic polynucleotide
ggtagtttggcttcttcatttgcttcggcattgagcgcgagtgcagcttcagtcgcttcgtcagctgccgcacaatcagcctctcagtcacaagctgctgcatccgccttttcccgagctgcttcgcaatcagcaagccaatcagcagcaaggtcaggagcgcaaagtagctctactactaccaccacatcagcatcaggttcccaggccgcaagtcaatccgcaagctccgcagctagtcaggcatcggcatcttccttcgcacaagcttcttctgcttccttggccgcctcttcatcattttccagtgcgttctccagcgccaactccctatcagctctcggtaacgttgcttatcaactgggtttcaacgtagcgaacactcttggcataggtaacgcacctggattgggagcggcattgtctcaggctgtttcttctgttggtgtaggagcatcctcctccacttatgctaatgtcgtctccaacgctgttggacagtttttagctggtcaaggagtactaaatgcagctaacgca

SEQ ID NO: 248 - DNA, 540 bp, Artificial Sequence
  Description of Artificial Sequence: Synthetic polynucleotide
ggtagtttggcctctagttttgctagcgctttgtccgctagtgctgcctctgttgcatcgtcagctgcagcacaatcagcgtctcaatcccaggcagcagctagtgcattttctagagcagcctcacaaagtgcttcccaaagtgccgccaggtcgggagctcaatcatctagcaccactacaacaacttctgcttcgggatctcaggccgcatcccagtccgcttcctccgccgcatctcaagcttctgcctcttcatttgcccaggcttcatctgcatcattggctgcttcgtcctccttttcatccgccttttctagtgctaactccttgtcagcacttggaaacgttgcttaccaactaggatttaatgtagccaatacacttggcataggaaacgcccctggattaggagcggcattatcacaggctgtctctagtgttggagtgggagcttcaagctctacgtacgcaaacgttgtctccaatgccgttggacagtttttggctggtcaaggagttttaaatgcagctaacgca

SEQ ID NO: 249 - DNA, 540 bp, Artificial Sequence
  Description of Artificial Sequence: Synthetic polynucleotide
ggtagtcttgcaagctcatttgccagcgcactgtctgcttctgccgcttcagttgcatcaagcgctgcagctcagagcgcatctcaaggacaagctgctgcttccgcattctctagagcagccagtcaaagcgcctcgcagtctgctgcaagatctggtgctcaatcatcaagtacgacaacaacgacttcagcgtcgggaagtcaggccgcttctcaatctgcttccagtgctgcctcacaagcctcagcttcgagcttcgcccaagccagttccgcctccctggcagcttcttctagcttttccagcgctttctcttcagctaattctctaagtgcgctgggaaatgttgcttaccaattgggtttcaacgtagccaacacactaggtatcggaaacgcaccaggtctaggtgcagctttatcccaagcagtttcaagtgttggtgtcggtgcttcttcctcaacctatgccaacgtagtctcaaatgccgttggtcaatttctggccggacagggcgtgctgaatgccgcaaatgca

SEQ ID NO: 250 - DNA, 579 bp, Artificial Sequence
  Description of Artificial Sequence: Synthetic polynucleotide
ggttcggcgacaagctctactaccacgactactaccgtttccaaatccgctgctgctgcagctgcagcagcagctgctgcaagttcagcctcgtctgctagtagagattctgatcgatctagtaccgctgcggaggcttacgcttctagcagtgcttacgccagtagcaatttcgaaaactacttggctagcgacttgtctaattctgatgagttcgaatcggtatatggctccttatactcctccgcagacgcagcctcgtacgcaagatcttctgcagaatacgcctcgaacacgttaggtctttctaaggaaacatcgtatgccctggcatcagctgcggctaaagcagttagcgaatccggatcaggatcatccagttacgccagagcttacgccgtagctaaatcctctgctgtggtcttgcaaaactctggtgtacttagcagttctaactccagaagtttgtcgtcagcttttgccaaggctttcgcatcttcttccgcgagtagctatgcttcgtatcagtctaggaacacaggtacaagtagggcatcatctgctggttctggtgcagca

SEQ ID NO: 251 - DNA, 579 bp, Artificial Sequence
  Description of Artificial Sequence: Synthetic polynucleotide
ggttccgcgacctcatccactactacaaccacaacagtttccaaaagcgctgctgccgcagcagcagctgcggctgccgcttcctccgctagttccgctagtagagactcggatagaagtagtaccgcggctgaggcgtatgcctcttcctcagcttacgcctctagcaattttgaaaattatttagcatccgatctatcgaactcagatgagtttgagtcagtgtacggatccgtctattcatcctcggacgctgcctcttatgcaagatcgtctgccggttacgccagtaacacccttggattgtccaaagaaacgagttacgctctggcctccgccgctgctaaagcggttagtgagtctggaagtggatcttcttcttatgctagagcgtacgctgttgctaaatcttccgctgctgttttgcagaactcgggagtcttgagctctagtaacagtcgtagcttgagtagtgcatttgctaaggcttttgcttcctcttcagcaagttcttatgcctcgtatcagtcacgtaatacaggaacttcacgagcgtcatccgcaggctcgggcgctgca

SEQ ID NO: 252 - DNA, 579 bp, Artificial Sequence
  Description of Artificial Sequence: Synthetic polynucleotide
ggtagcgccacttcttccactacaactactacgacagtatctaaatcggctgccgcagctgctgcagctgccgctgccgcttctagcgccagcagcgcctctcgtgattcagacagatcttcgactacggccgaggcctacgcatcttcgagcgcttatgcctcaagcaattttgaaaactacctagctagcgatctttcgaattctgacgagtttgaatcggtgtacggaagcgtgtattcgtctagtgatgcagccagttatgctcgttcatccgcaggttatgcttcaaatacactcggactgtccaaggaaacttcctacgcacttgcctctgctgccgcgaaagctgtttctgaaagtggttccggaagttcttcatatgctcgcgcatatgcagtggccaaaagttccgccgtagtattgcaaaattctggtgtcctaagctctagcaattcgcgatctttatcctcagcatttgctaaggcctttgcgtcgagtagtgcctcctcctacgcgtcctacaaaagtcgtaacacaggtacgtctagggcaagcagtgctggtagtggtgctgca

SEQ ID NO: 253 - DNA, 579 bp, Artificial Sequence
  Description of Artificial Sequence: Synthetic polynucleotide
ggtagcgcaaccagttccacaaccactactacaacagttagtaaaagcgctgcagctgccgctgctgcggctgctgctgccagttccgcatctagtgcttccagagactccgatagaagctctactgctgccgaagcttacgcttcttcctccgcttacgctagctcgaattttgaaaactacctggcaagtgatcttagcaattcagatgaattcgaaagtgtatacggatccttgtattcaagtagtgacgcagcttcttatgcgcgttcatccgctggttacgcctccaatacactgggactttccaaagaaacatcttacgcgttggcttctgctgccgctaaagcagtgtccgagtccggatctggtagtagttcatacgcgagggcttacgctgtggctaagtcctcagccgtagtcttgcaaaactctggtgttctatcatctagtaactctagaagcctctcatctgccttcgcaaaggctttcgcctcttcctcggcatcatcatatgcttcatataagtcaaggaatactggcacctcgcgtgctagctctgctggaagtggagctgca

SEQ ID NO: 254 - DNA, 579 bp, Artificial Sequence
  Description of Artificial Sequence: Synthetic polynucleotide
ggttcagcgacttcgtctacaactacgaccaccacagtttctaaatctgcagcagcagctgccgcagctgcagctgctgctagtagcgctagctcggccagaagggattctgacagatcctcaagtacagcagaagcctacgcgtcctcatctgcttatacgtcatctaattttgagaactatctagccagtgatttgagtagctccgacgagtttgagtccgtttatggatctctctacagtagttcagatgccgcttcgtacgctcgatcgtctgctgaatatgccagtaataccctgggtctgtctaaagagacaagttatgctctcgcttctgcggccgccaaagctgtttcagaaagcggttctggctcatcgagttacgctagagcttatgccgtggccaaaagctctgccgtggtgttacaaaattcaggagttttgtcaagctcgaattcaagaagtttatcgtctgcatttgccaaggctttcgccagctcttccgcatcatcatacgcttcttacaaatctagaaataccggtacttccagagcctcctcagctggctcgggagctgca

SEQ ID NO: 255 - DNA, 579 bp, Artificial Sequence
  Description of Artificial Sequence: Synthetic polynucleotide
ggtagtgctacttcgtcaacgacaacaactacaacagtttccaaatcagctgcagcggccgctgccgctgctgcggctgcttcctcagctagctctgctagcagagattcagaccgaagttctactgctgcagaggcatatgcttccagttctgcatacgcttcttcgaatttcgagaactatttggcctcggatttgtcgaactcagacgagtttgagtccgtatacggttctttgtactcctccgcagatgctgcatcttacgctagctctagttctgaatatgcatcaaataccctcggtctatctaaggaaacctcgtatgctcttgcatcagctgctgctaaggctgtgtcagaatccggaagtggctcctcttcctacgcaagagcatatgccgtggccaagagctctgccgtggttttaaggaactcaggtgttctttcctcatcaaactccagatccctttcgtccgcatttgcgaaggcattcgcttcatcctctgcatcaagttatgcatcatataaaagtagaaatacaggcacctccagggcatctagtgcgggctcaggagccgca

SEQ ID NO: 256 - DNA, 579 bp, Artificial Sequence
  Description of Artificial Sequence: Synthetic polynucleotide
ggttcagcaacctcatcaactacaacaacgaccactgtgtctaagtctgctgctgcagctgctgcggcggccgcagccgctagttctgcatcgtccgctaggagagattctgatagatcttcaagcaccgccgaagcatatgctagttcctctgcttacacctcttccaattttgaaaattacctcgcttccgacttaagttcctcagatgaattcgaatccgtttatggtagtctgtattctagttctgacgctgcttcttatgctagaagctctgcggaatacgctagcaacactttgggtttatcaaaagaaacatcttacgctttggccagtgctgctgctaaggccgtctcagaaagtggatctggtagcagttcttacgccagagcctatgctgtagctaagtcatctgctgtagtcttgcagaactccggagtcttgtcgagcagtaacagtagatcattgagttcagcttttgcgaaagcttttgcatcctcttcagcttcatcctacgccagctcaaaatcaaggaacacaggaacctcccgagctagtagcgcaggttccggagctgca

SEQ ID NO: 257 - DNA, 558 bp, Artificial Sequence
  Description of Artificial Sequence: Synthetic polynucleotide
ggttcttttgcctctgcctcagcatacgctttcgcatttgctagcgccttttctcaagtcttatccaattatggtttgctcaatatcaataacgcttacagcttggcctcgagtattgctaacgcggcgagcgcttcagcatcatcagctgcagctgctgcagcttcatcttcttctgctgcagcggccgctgcagccgcttctggcgctgcaggtagcgcagctgcaacttcgaccactacatcgacatcgtcatctactgcagcagctgccgcttctgccgccgcttcagctgccgcctccgccagtggagccgccagagctgccggagcctcttccgccgcgtcagacgcttccgcatcaagcagtttacagcaatccttgggttcagcattggctcagtcatcttcctttgccgcagcctttgcccaggcaaactcagcagcatccgccgccgcaattgcatacgctctagcacaaatcgttgctaaccaaataggattttcatcttactcttcagctttcgctagtgcggcttcatcagccgtttcatcacta

SEQ ID NO: 258 - DNA, 558 bp, Artificial Sequence
  Description of Artificial Sequence: Synthetic polynucleotide
ggtagctttgcatcggcctcagcttatgcatttgctttcgcctcagctttttcgcaagtcttaagtaattatggattattgaacatcagtaacgcctacagtctagccagttctattgcatccgctgctagtgcatctgcaagttctgccgccgccgctgcagcgtccagctctgcagctgctgctggtgccgccgcagcttccggcgctgcaggtagtgctgcatcaacgagtactacaacttcaactagtacaagtaccgcagccgcagctgcaagcgcagcagctgcagcagctgcttctgcatcaggtgcagcccgagcagctggcgcgtcctcagctgcttccgctgcatctgcttccagcagcctgcaacaatctttgggatctgccttagcacaaagttcttccttcgcagctgcatttgcccaagccaattctgctgcttctgcggctgccatagcctacgccctggcccagactgttgcaaaccagataggtttttccagctattcgtctgcatttgctaccgccgcttcttctgctgtttcctcctta

SEQ ID NO: 259 - DNA, 558 bp, Artificial Sequence
  Description of Artificial Sequence: Synthetic polynucleotide
ggttcattcgcatccgctagtgcctatgcctttgcatttgccagtgcattttctcaagtcctgtcgaactatggattattaaatatttccaacgcctacagcttggcttcttcaatcgctaatgcagcttcggcttcagccagtagcgccgctgcggccgctgcatcatcttcctctgccgcagccggagcagccgcagcttcaggagcagccggctcggttgccgctacaagtactactactacggctagtacttcaactgccgcggctgccgcttctgccgctgctgcagctgctgcttctgcttctggcgccgctagggccgctggtgctagttcagctgcaagtgccgcctcagcctccagtagtttgcagcaatcactgggaagtgccttggctcaatcctcatcattcgccgccgcattcgcgcaagccaattcagcggcatctgctgctgctatcgcttacgctttggctcaaacagtggcaaaccaaattggattcagttcatactcctccgcgtttgcatcagcagctagctccgccgtttattcatta

SEQ ID NO: 260 - DNA, 564 bp, Artificial Sequence
  Description of Artificial Sequence: Synthetic polynucleotide
ggtgccagcgcatctgcctacgctagcgctatctctaatgctgttggtccttatttgtacggtctaggactctttaaccaagccaacgcagcttcctttgcttcctccttcgcaagtgcagtcagttctgccgtcgcttcagcttccgctagcgctgcttcctcagcatatgcccagtccgctgccgctgcacaagcacaggcagcttcatctgccttttcacaggctgccgctcaatcagccgcagcagccattgctggagcaagtgctggtgctggagcgtccgctggtgcaggagcttcagcaggagcaggtgctgttgcagctagtcaggcagccgcatcttcatctgcaagtgccgttgcgtcagctttcgctcagtcagcctcatacgcactagcttcaagttctgcttttgccagcgcttttgcttccgcaacatcagccggttacttgggatctttggcgtaccaattgggtttaaccaccgcatacaatttgggtttaagtaatgctcaagctttcgcaaacactctgtcccaggctatcgttggagtaggagta

SEQ ID NO: 261 - DNA, 597 bp, Artificial Sequence
  Description of Artificial Sequence: Synthetic polynucleotide
ggtgcttctgccagtgcgtacgcttcggctattagcaacgccgtaggtccatatttatacggtttaggcttgttcaatcaagcaaacgctgcatctttcgcttcaagtttcgcaagtgcagtttcaagtgcagtcgctagtgcttcggcctctgccgcttcatctgcctatgcgcagtcagcagctgcccaggctcaagccgctagttctgcattctctcaggcagcagcgcagtccgccgctgcagcttctgcaggagctagtgccggagctggagcgtcagctggagctggtgcagttgccggagccggagcggttgcgggcgcaggtgccgttgcaggtgctagtgctgctgccgctagccaagccgctgcatcgtcatcagcatctgctgtggctagtgcttttgctcagtcagcttcctatgctctggcttcatcaagtgcgtttgctaatgcatttgctagcgctactagtgcgggttacttgggatccctggcctatcaattgggactgacgactgcatacaaccttggattgagcaacgctcaagccttcgcttctactctgtctcaagccgtgacaggagtgggctta

SEQ ID NO: 262 - DNA, 618 bp, Artificial Sequence
  Description of Artificial Sequence: Synthetic polynucleotide
ggtgcatcagcaagtgcttacgcatccgctatctcaaatgcagttggcccttacttgtacggattaggtctgttcaaccaagctaacgctgcgtcctttgcctcttccttcgcttcggcagttagttcggcagtcgcttcggctagtgccagtgctgcatcttcggcatatgcccaatctgctgccgctgcacaagcacaggctgcgtcgagcgctttttcacaggctgctgcacaatcggcggctgcggcttctgctggtgcatcggctggtgccggagcatcagcgggtgcaggagcttcagctggagctggtgcaagtgcaggcgcaggagctagcgccggcgctggtgctattgcaggtgctggagccgcagccacgagtcttgctgcagcctcctcatctgcttccgctgtagcttctgcttttgcacaatcagcatcttctgcattggcctcttcttccgctttcgctaatgcttttgctagtgccacctctgtctccgcactgaatagtatagcttatcagatgggtgtgtccgctgcaaatattttgggaataagcaacgcacaaggatttgcaaatgctttgagccaggctgtaggtgttgttggtgta

SEQ ID NO: 263 - DNA, 552 bp, Artificial Sequence
  Description of Artificial Sequence: Synthetic polynucleotide
ggtatacttactcaagaaaatgcagctggtttagcttcatccgtttcctccggtatatcaagtgcagcaagctcggtggcagctcaagcggcctcagctgcacaatcttctgcctttgctcagagccaggcggccgctcaagctttttcgcaggcagcctcaagatcagcgagccaatccgcggctcaagctggatcttcctccactagtacaacaactactacatcacaagctgcttctcaagctgcctcccaatctgcctcctcttcgtctagcgcagcttcacagagtgcttttagtcaagccagttcttcggctttagcttcgagttcaagtttctccagtgccttttcttcggcatcgtctgccagcgccgttggtcaagtaggataccagattggacttaatgcagctcaaactcttggtattagcaatgcaccagcgttggccgatgctgtttcacaggctgtcaggaccgttggagtcggtgcctcaccatttcaatacgcaaatgccgtctctaatgccttcggacagctcttgggcggacaa

SEQ ID NO: 264 - DNA, 552 bp, Artificial Sequence
  Description of Artificial Sequence: Synthetic polynucleotide
ggtattttgacacaagagaatgcagccggactggcttcctccgtttctagcgctataagctccgccgcttcctcagtcgctgcccaagcagcctcagccgcacaatcttctgcttttgcacaaagtcaagctgcagcacaagctttttctcaagctgccagcagatcagcttctcagagtgctgcacaagctggaagctcaagtactagtactactaccaccacctcacaggctgcgtcgcaagctgcttcacaatcagcaagctccagctctagtgctgcctcccagagcgcattctcacaagcgagttcatctgcgttagccagtagctctagtttttcttcggctttttcttccgcctcgtccgcatccgctgttggacaggttggataccagatcggcttgaacgccgcacagacattgggaatttctaacgcaccagcccttgcagatgctgtaagtcaggctgtacgtacagtgggcgttggagcttccccattccaatacgctaacgccgtctccaacgcctttggccagttgttgggaggccaa

SEQ ID NO: 265 - DNA, 552 bp, Artificial Sequence
  Description of Artificial Sequence: Synthetic polynucleotide
ggtatcttgactcaagaaaatgccgctggattagcctcttctgtgtcatcggccatttccagtgctgctagttccgttgcagcacaagctgctagtgcggcacaatcttcagctttcgctcaatcccaggcagctgcacaagcattttcccaggctgcatcgaggtctgcttcccagtctgctgcccaagcgggatcatccagcacttccacaacaaccactacatcacaggctgcaagtcaggcagcatctcaatcagcaagctcttcatacagcgcggcttcgcagtcagctttttctcaagctagctcatccgctttggcttctagttcttcgttctcctcagctttcagctctgctagtagcgcttctgccgttggtcaagttggttatcaaattggactgaatgccgctcagacattaggaatctctaatgcaccagcattcgctgatgccgtttctcaggctgttagaactgtcggagttggagctagcccattccaatatgctaatgctgtttcaaatgctttcggccaactgctaggaggccaa

SEQ ID NO: 266 - DNA, 552 bp, Artificial Sequence
  Description of Artificial Sequence: Synthetic polynucleotide
ggtatcctgactcaagaaaatgctgcaggtttggcttcatccgtatcttctgctatttctagtgcagctagctcagttgcagcccaagcagcatccgcagcccaaagctcagctttcgcacagtctcaagctgctgcacaagctttttctcaagcagcctccagaagtgctagccaatctgcagctcaggctggaagttcatctactagtacgactacgacaacatctcaagccgcttcacaggctgcgagtcagtccgcttcatcttcctattccgctgctagccagtccgccttctctcaggcttcttcgtccgcattagcctcctcatcgtcattttcgtctgccttctccagtgcttcttctgccagtgcggtaggacaggtaggataccagatcggtttgaacgcagctcagaccttgggaatctctaacgcccctgcctttgccgacgcagtcagtcaggcggttagaacggtaggagtaggtgctagtccgttccagtatgctaatgctgttagtaatgctttcggtcaattgttaggaggacaa

SEQ ID NO: 267 - DNA, 552 bp, Artificial Sequence
  Description of Artificial Sequence: Synthetic polynucleotide
ggtattctcacgcaagagaacgctgccggtctggcatcgagtgtcagttccgccatttcgtccgcagcatcttctgtggcggcacaggccgcttcagctgcacaatcatcagcttttgcccaaagtcaagcagccgcccaagctttatcgcaagcagcatctaggtctgcatcacagagcgcagctcaagctggctcgtcgtctacctccaccacgaccactacttctcaagccgcatcccaagccgcaagtcagagtgctagtagctcgtattcagcagcctcgcaaagtgcctttagccaagcctctagttcggccttagcatccagttcgtcgttctcaagtgcttttagtagtgccagcagtgcgtctgctgtcggacaagtaggttaccagattggcttaaatgctgctcagacactgggaatctcctccgctcctgccttcgccgacgctgttagccaggcggtcagaacagttggagtgggcgcttctccatttcaatatgcaaatgcagtctctaacgcctttggtcagttactgggaggtcaa

SEQ ID NO: 268 - DNA, 552 bp, Artificial Sequence
  Description of Artificial Sequence: Synthetic polynucleotide
ggtattcttactcaggaaaacgctgccggtttggcttcttcagtttcttcggcaatttcgtctgctgcgtctagcgtagcatcccaagctgccagtgctgcacaatcaagtgcttttgcacaaagtcaagctgctgctcaggctctatcccaagcggcttctaggtcggcgtctcagagcgctgctcaagctggttcatcatctacctctaccacgacgaccacttcgcaagcagcttcccaggcagcctcacaatcagcatctagttcgtactcagctgcttctcaaagtgccttttcccaagcttcctcctccgcactagcaagttcatcaagcttcagttctgcatttagtagtgcctcttcagctagtgctgtgggtcaggtaggataccaaatcggtctaaacgccgcacagacacttggtatctccaatgctccagcctttgctgatgctgtgtcccaagcagtacgaactgttggcgttggcgcctcgccattccaatatgctaacgcagtgtctaatgccttcggtcaattgttgggagagcaa

SEQ ID NO: 269 - DNA, 513 bp, Artificial Sequence
  Description of Artificial Sequence: Synthetic polynucleotide
ggtgttttgaatgctggtaacgcttcggctcttgctggttcttttgcaagagccttgtctgcaagcgctgaatcacagagttttgctcaatcacaagcttatcagcaggccagtgcttttcagcaagctgctgctcagtccgcagcacagtcagcttctagagctggcagcacctcaagttctacgacaacaactacttcgggagctacatctcaagcagcttctcaaagcgcatcttctagttattcgagtgcctttgcacaagccgcttcttcctccctcgcaacctcttccgccatttccagagcatttgcctcagttagttcagcctctgccgcaagtagtctagcttacaacataggactatcagctgctcgcagtttgggaattgcatccgataccgccctggctggtgcattggcccaggccgtaggaggtgttggtgcaggtgcttcagcgtcagcgtatgcaaacgctatagctagagccgctggacaattcttggcaacacaa

SEQ ID NO: 270 - DNA, 513 bp, Artificial Sequence
  Description of Artificial Sequence: Synthetic polynucleotide
ggtattgcttccgatacagccttagctggagcattagctcaggcggttgccggtgttggtgctggagcttcggctagcacatacgccaacgtcatagccagagccgcaggacaattcttggcaacacagggcgttttagatgctggcaatgcaagcgctcttgctggttctttcgccagagcgctgagtgctagtgctgagagtcagagctttgcccaaagccaagcttttcaacaagcttcggccttccaacaagccgcaagtcaatcggctggtcaatctgcttcacgtgctggttcaacatcgagttcaaccaccactacgaccagcgcagcagcctcgcaggctgcatcccaatctgctagctcatcatcttcttctgcatttgctcaagccgcttcgagttctctggctacttcctcagcaatctctagagctttcgcgtccgtgtcatctgcgtctgcagcatcgagtttggcttataccatcggacttagtgctgctcgatcttta

SEQ ID NO: 271 - DNA, 513 bp, Artificial Sequence
  Description of Artificial Sequence: Synthetic polynucleotide
ggtattgcttccgataccgcattagcaggagccttggcacaggctgttgctggtgttggtgcaggtgcatctgcgtctacatatgcgaatgtcattgcacgtgctgctggtcaatttcttgctactcaaggtgtcttggatgcaggtaatgcttccgcattggccggatcgttcgccagagctctttctgcttcggctgaatcacaatctttcgcccaatcacaagcctttcagcaggctagcgcttttcaacaggccgcttctcaaagtgcaggacagtcagcttcccgtgctggttccaccagttcttcgacaacaactacaaccagcgccgctgccagtcaagctgcatcacaatcagctagttcatcaagcagtagtgctttcgcacaagcagcaagttcctccttggcaacttcttctgccatttcaagagcttttgcttcagttagtagcgcttctgcggcatcgtcgcttgcatatacgattggcctgtccgccgctagaagtcta

SEQ ID NO: 272 - DNA, 513 bp, Artificial Sequence
  Description of Artificial Sequence: Synthetic polynucleotide
ggtatagcctccgatacggcactagctggcgcacttgcccaggcagttgctggagtaggtgctggtgcttcggctagtacttacgctaacgttatagctcgtgcagctggtcagtttttggcaacccaaggagtgctggatgcaggcaatgcaagtgcattggctggtagcttcgcccgagctcttctggcttctgcggaaagtcaatcatttgcacagtcacaagcttttcaacaagcttctgccttccaacaggctgcaagtcagtcagccggacaatctgctagtagaagtggatcgagatcgagttcaactactactacaacttctgctgctgcatcccaagcagagtcacagtctgcctcatcatcctcctctagcgcttttgctcaggccgcctcctcaagcctggccacttcaagtgcaatttcacgtgctttcgcttcagtttcttctgcttccgccgcttcctctcttgcctataccattggattgtctgcagcacgtagtcta

SEQ ID NO: 273 - DNA, 513 bp, Artificial Sequence
  Description of Artificial Sequence: Synthetic polynucleotide
ggtatcgcttctgacacagcattagctggagcattggctcaagccgtcgcaggtgttggtgcaggagcctctgcctcaacatacgcaaatgtcatagcgagagcagctggccagttcttggctacacagggtgtcctagacgctggtaatgctagtgctttggctggatctttcgccagagccttgtcagcatctgctgagtcgcaatcttttgcccaaagtcaagctttccaacaggctagtgccttccagcaagcagccagccaatcagctggacaatcagcgtccagagccggttccacgtctagttccactaccacaactacctctgctgccgcaagtcaagcagcaagtcaatccgcttcttcgagtagttcctctgcttttgcacaagctgctagctcctctttggccaccagttctgctatctcgcgtgcctttgccagcgttagctcagcttccgcagcttcttcattggcttatactattggtttatctgctgccagaagttta

SEQ ID NO: 274 - DNA, 513 bp, Artificial Sequence
  Description of Artificial Sequence: Synthetic polynucleotide
ggtattgcttcagatacggctttagctggcgccctagcccaagctgtggccggtgtaggtgctggagcatcggctagtacttacgcaaatgtgattgccagggctgccggtcaatttcttgctactcaaggtgtactggatgctggtaatgcctccgccttggcaggatctttcgctagagctttgagcgcatcggcagaatcacagtcttttgctcaatcccaagcattccaacaagccagtgcgttccagcaggcagcttcccaaagcgcaggacagtctgcttcgagagctggaagtacatcttcatccaccactacgacaacctctgccgctgcctctcaggcagcgagccaatcggcctccagttcttcatcttccgcatttgctcaggctgctagtagctcccttgcaacttcctctgctatatcgagggccttcgcttcagtgtcaagtgcttctgctgcaagttcgcttgcttataccattggattgtcggcagccagatcacta

SEQ ID NO: 275 - DNA, 513 bp, Artificial Sequence
  Description of Artificial Sequence: Synthetic polynucleotide
ggtattgctagtgatactgctttagccggagctctggctcaagctgtggctggtgttggtgcaggagcatctgctagcacttacgctaacgttattgctagagctgccggtcagtttctggctactcagggagttttggatgcaggtaatgcgtctgccctcgcaggttccttcgccagagccctgagtgcctctgccgagtcccagtcatttgctcagagtcaagcttttcagcaagcttcggcctttcaacaagccgcatctcaatcggcaggacagtcagcatctagagcaggtagtacctcaagctcaaccactactaccacctcggttgctgcttcgcaagctgcttcacaatccgccagctcatcttctagttcagccttcgcacaagctgcctcatcctcattggccaccagtagcgccatatcaagagctttcgcaagtgtttcatcagcgtctgctgcatcatccctggcctataccattggattgagtgccgcaaggtcctta

SEQ ID NO: 276 - DNA, 513 bp, Artificial Sequence
  Description of Artificial Sequence: Synthetic polynucleotide
ggtattgcttccgatactgctctggctggagctcttgcacaggctgtggcgggtgttggagctggtgcatctgcctcaacttacgcaaacgtgattgcaagagctgccggtcaatttttggcaactcaaggagtgttggacgctggtaatgcatcagccttagccggatcttttgcaagggctctatctgccagtgctgaatcgcaatcctttgcccaatcacaagcctttcagcaggcttccgcttttcaacaagcagcttcccaaagcgctggacaatcagctagtagggctggaagtaccagctcctcaactactactaccacatccgccgccgcttcgcaggctgcaagtcaatcagcctcctcatctagctcatccgcatttgcacaagctgcttcatcatctcttgcaacttcatctgctatctctagagcttttgctagcgtatcaagtgcaagcgctgcatcttccctagcctatactattggattatctgccgctagatcttta

SEQ ID NO: 277 - DNA, 513 bp, Artificial Sequence
  Description of Artificial Sequence: Synthetic polynucleotide
ggtattgcctcagatactgcattggctggtgctttagctcaggccgttgcaggtgttggagccggtgcctcagctagtacctatgccaacgttattgctagggccgcaggacaatttttggcaactcaaggagttttggatgccggcaacgcttccgcacttgcaggttccttcgcaagagctttgtcagcttcagctgaatcacaatcttttgctcaatcgcaggcgtttcaacaagctagcgctttccaacaagctgcatcacagtcagccggtcagtcagcgagtagagcaggttcaacctccagttctactacgactactactagcgccgctgcttctcaggccgcatctcagtccgcttcctctagttcttcctcagcatttgcccaggctgctagcagctccctagcaacaagttccgcaatatctcgtgcatttgcttccgtttcttcagcatcagcagcctcctcactggcctacacaataggactatctgctgccaggagtcta

SEQ ID NO: 278 - DNA, 513 bp, Artificial Sequence
  Description of Artificial Sequence: Synthetic polynucleotide
ggtgacaccgctgcttcctatggtaatgctttgagcacggcagctggacaattttttgccacggctggattgttaaatgccggaaatgcgtccgcattggcttcaagcttcgccagggctttttctgctagcgctgaaagtcaatcatttgctcagtcccaggctttccagcaagcatcagcatttcaacaagcagcttctagatctgcttcccaatccgcagctgaagctgactcaacgtcatcttcgacaaccacgactaccagcgctgcccggtcccaagctgctagtcaatcggcatctagttcttattcatcggcattcgctcaggcggccagttcaagtttcgcaatcagctctgccttgtcgagagcattttcttccgtttcaagcgcatctgcagcatcttctctagcatatagcatcggcttaagtgccgctaggagcttaggaattgctgacgccaccggccttgctggtgcccttgctcgtgctgtcggtgcgcttggacaa

SEQ ID NO: 279 - DNA, 513 bp, Artificial Sequence
  Description of Artificial Sequence: Synthetic polynucleotide
ggtgcgactgctgcttcctatggtaacgcactgtccacagccgcagctcagttcttcgcgacagcgggtctactcaacgcaggaaacgcatccgcgttagcttcatcctttgcaagagcgttctctgcttccgccgagtctcaatcattcgcacaatcacaagctttccaacaggcaagcgcttttcaacaggccgcatctcgttctgcctctcaaagtgcagccgaggctggttccaccagttccagtaccactactaccacctctgctgcaaggagtcaagctgcctcacaatctgcatcatcttcatatagttccgccttcgctcaagcagcatcgagttcattagctacatcatcagctctatctcgtgcctttagctctgtttcgtccgcttctgcagcttcaagcttagcttattccataggactatctgccgccagaagtttgggcattgcagatgctgccggattggctggtgttttagccagggcagctggagctttgggtcaa

SEQ ID NO: 280 - DNA, 522 bp, Artificial Sequence
  Description of Artificial Sequence: Synthetic polynucleotide
ggtcaatttttggccaaccagggtatactaaacactggaaatgcttcatcgttggcgagttctttcagttctgcgctttccgcatctgctgcagccgcccaaagtcaaagtttcgcgcaatcgcaagctgcggctagcgcatttcagcaggcggcctcccaaagcgctagtcaatcagctgcccaatcgggttcgcaatcatcgtctaccactacaactactagtgcatcaggaagtcagtccgcttcacaaagtgcctcttctagttctgccagcgcctcagccttcgctcagcagagctctgccagtctagctgctagctcttcgttctctcaggctttcgcgtctgctgcatccgcttccgcagttggaaacgtcgcctaccaattgggattgtctgcagcacaatctctcggtattgctaatgctggagctctagcatcagcattagcacaaagcgttagttctgtgggtgtgggtgcatctagttcagcttacgctaacgcagtcgctggagctgta

SEQ ID NO: 281 - DNA, 834 bp, Artificial Sequence
  Description of Artificial Sequence: Synthetic polynucleotide
ggttctcaggcgggttcgcaggcaggatcccaagctggatcgcaggccggatcacaggcggcatcacaagcaggatctcagtcagcctctcaggctagtgctagctcatctgctagcgcatttgcttcggccagtgcgtttgctcagagtgcttctttcgctttatcttcttctagttcttttgcctccgctgtgagctcagccagttcagtctcagcgttgggtaccttaggctatcaagttggactgcaagctgcgggaagcttaggaatctctaatagccaagcatttgcgtcatctatctctcaagctcttacgtctgttggagttggtgcctcctcatccgcttatgcatctgcagtatctggagtggttgctcagtatttgtctggaactggagtattaacatctgcaaacgcacaagctttggctagttctttcgctaatgtatttgctgcatctgccgcctccgcctctgctgcagcctctgcctcttctgctgcttccgcgcagagtgccgcagccgctctcgctcaatcgcagtccgcagcatctgcattctcacaagcggctagtcaggctttttcgcaagctgcatcccaggctggtagtcaagctgcctcacaagctggttctcaagcagctagccaagctggatcccaggccgcctctcaagcaggttctcaggccgcttcacaagctggcagccaagcagccagtcaatctggatctggtgcctcttcgttcactacaacaataagccgttctagtgctggatcgcagacgggttcccaagccggatcccaggcaggcagccaagccggatcacaagca

SEQ ID NO: 282 - DNA, 906 bp, Artificial Sequence
  Description of Artificial Sequence: Synthetic polynucleotide
ggttcacaggcgggttctcaagccggttctcaggcaggttcccaagctggatcacaggcaggatctcaggcaggatcacaagcaggtagtcaagccggctctcaagctgcttctcaggctggatctcagtccgcgtcacaagcctccgcctcttcttctgcatcagcttttgcgtctgccagcgctttcgcacaatctgcttccttcgcactttcttccagtagttcttttgcttctgctgtcagctcggcatcttccatcagcgccttaggaacgttgggatatcaagtcggactgcaagccgccggatctttgggaatttctaactcacaagccttcgcatcttcaatctcacaagcattgacttccgttggtgtcggtgcttcttcttctgcttatgcaagtgctgtatcgggtgttgttgctcagtacctttcaggaacaggtgtgctgacttccgcaaatgcacaggcattggcaagttccttcgctaacgtgttcgcagcttctgcagcgtctgctagtgctgcagcctctgcatcatcagctgctagtgcccaaagtactgctgccgccttagctcaatcgcaatctgcagcatctgctttttcccaagctgcttcccaagcatttagtcaagctgcttcacaggccggttcgcaagctgcttctcaagcaggatcacaggctgcgtcccaagctggttctcaggctgcttcacaagctggatcgcaagctgcttcgcaggctggttcacaggccgcctcacaggctggatcgcaagcagcttctcaatccggatcaggagctagctcatttactaccaccattagcagatccagtgctggatcgcaagcgggatctcaagcaggcagccaagcaggatctcaggccggatctcaagca

SEQ ID NO: 283 - DNA, 834 bp, Artificial Sequence
  Description of Artificial Sequence: Synthetic polynucleotide
ggttctcaagctggaagtcaagctggatcgcaagcaggtagtcaggcaggttctcaggctgctagtcaggccggctctcaatccgcatctcaagcttcagcttcttctagcgcttctgcatttgcttctgcttcggcatttgctcaatctgcctctttcgctcttagttcgtcctcatcatttgctagcgcagtttcaagcgcttcatcggtttcagcattgggcaccttgggataccaagtaggactgcaggcggcaggatcactaggaatttctaattcacaggcttttgcgtcaagtatttcgcaggccttaactagcgttggagttggcgcatctagttctgcgtatgcctctgccgtgtccggagtggtcgcccagtacctgtctggcactggtgtgttaacttctgctaatgcgcaagcacttgcatcatcatttgctaatgtttttgcagctagtgctgcgagcgcttccgcagctgcctcagcttcttcagccgccagcgctcaatcagccgctgccgccttggcccaatcgcagtccgcagcctcagcatttagccaggcagcctcacaggccttctcacaagcggcttctcaggctggctctcaagccgcctcacaagctggtagtcaagccgcatcacaggcaggatcccaagctgcatctcaggctggatctcaagctgcctcccaagcaggtagccaggctgcttcgcaatctggtagtggagcttcctcatttacgactactatttctcgttcatctgctggtagtcagacgggtagtcaagctggttcacaagccggttcacaggctggatcacaagca

SEQ ID NO: 284 - DNA, 906 bp, Artificial Sequence
  Description of Artificial Sequence: Synthetic polynucleotide
ggtagtcaggcaggatctcaagccggatcccaagcgggaagtcaagctggttctcaagctggatcgcaggctggaagtcaggccggatcccaggcaggaagtcaagctgcttctcaagccggaagtcagtcagcctctcaagcctcggcatcttcgtcagcttctgcgtttgcctccgcttctgcattcgctcaaagtgcctcgttcgctttaagttcgtcaagtagtttcgcatcagccgtttcttcagcctcttcgattagtgccctgggaactttgggttatcaggtgggcttacaggctgccggttctttgggcatctcaaatagtcaagctttcgcttcttcgatttctcaggcattgacttctgtcggtgttggtgccagcagttctgcttacgcgtctgctgtatctggagttgttgcccaatatctatctggaacaggtgtgttgacatcggccaatgcacaagctcttgcttcttcttttgccaacgtttttgcagcttcggctgcatcggcatctgccgctgcttctgctagtagtgcaacaagcgctcagtccgctgcagctgcacttgcacaatcgcaagctgccgcttctgcattttcacaagctgcttcccaagcaagttcccaggcttcgagccaggcttcttcccaggcagcttcccaggcctcttcacaagctagctctcaggccggaagccaggctagctcacaggccgcatcccaagctgcaagtcaggctgctagtcaagcagctagtcaagctgcctcccaatctgccgcttcagcacgtgctggagctagcagcgcgtctttcagcgcttcgcagtcaaatgctgcctctcaggctggctctcaagctgcctcacgtgctggctcacaagccgcctcacaggca

SEQ ID NO: 285 - DNA, 429 bp, Artificial Sequence
  Description of Artificial Sequence: Synthetic polynucleotide
ggtggtgctggatctgcaggtggttacggtgagggcgcaggtgcaggtgtcagatcaggcgctggagcctccgccggagctgccggtggttatggaagagctacaggtgcaggtgcaggaggagcagccgcagccggcgcttcaggatatggaggtagctacggagcaggtgccggagctggtgccgcaggtgcgggtggagcatctgcttatggagctggtattggaggtggttatggagcaggcgccgctgatgcctatggtggtggtgcttccgctggagccggtgccggtgcaggagcaggcgtttcaggtggatatggaagagcagctggtgctggagccgctgctgcagctggtgcaaacggctacggtggtagctatgatgctggagtgggcgcaggtacagcaggtgccggtgctggtgca

SEQ ID NO: 286 - DNA, 456 bp, Artificial Sequence
  Description of Artificial Sequence: Synthetic polynucleotide
ggtgcctcaggaggctacggaggaggtgcaggtgagggagctggagctgccgctgcagcaggagctggtgcaggaggtgccggtggatacggtggaggtgctggatccggagccggagcagttgccagagctggcgcaggaggtgcaggaggatacggatctggtataggcggaggttacggttctggtgcaggtgccgcagcaggtgctggcgcaggtggtgctggagcatatggaggaggatatggaacaggagctggtgccggagctaggggtgcggattctgccggcgcagccgccggatatggaggaggcgttggaactggtacgggttcatcggccggatacggtaggggtgccggagctggagcaggcgcgggtgctgccgctggatccggtgcaggtgctgcaggaggttacggtggaggctacggagcaggcgctggtgctggcgca

SEQ ID NO: 287 - DNA, 396 bp, Artificial Sequence
  Description of Artificial Sequence: Synthetic polynucleotide
ggtgccggcggtgcaactggaaaccgtgctggtgacgccttcgcccaggtattcagtcagaatgttattaacagtggagtaattacatcaaccaccgttactaagaattctgcccaggctgctgcatcttctatggtatccacagcggcgaaaagtttgggtttagatgagaataccgcccggtccatggcaaacgctatgtctagctacgctgcagctatggctaagagttttagaaattccgacgaatttataagaaatatgtcataccagatgggaagaatgcttagcaacgctggtgctatcaatgagtctactgcctccgccgcagcaagttctgcatcctcaactgttactgaaacagtgcgcacctacggtccagcagccatattttca

SEQ ID NO: 288 - DNA, 540 bp, Artificial Sequence
  Description of Artificial Sequence: Synthetic polynucleotide
ggtgcaggtgccggtggagccggcggttacgctcagggatatggagccggtgccggtgctggtgcaggtgctggtaccggagctggaggagctggtggatacggtcaaggttatggcgctggttcaggagcgggagcaggtggtgcaggtggttacggagccggagcgggtgctggagcaggtgctggaggagcatcaggttatggacaaggttacggagatggagctggtgctggtgccggcgctgctgccgcagcaggagccgctgctggagctagaggagcaggtggatacggaggtggtgccggagatggagcaggagccggtgctggtgccggagctgctggtggttacggacagggatacggagctggtgagggtgcaggtgctggagctggcgccggtggcgccggaggatatggtgctggtgctggagctggaggcgctggcggttacggacaatcttacggtgacggagcagccgcagctgctggatcgggtgctggagctggtggatctggcggatacggtgctggagca

SEQ ID NO: 289 - DNA, 546 bp, Artificial Sequence
  Description of Artificial Sequence: Synthetic polynucleotide
ggtgcaggtgctggtgcaggtgcaggttcaggtgctggtgctgcaggtggctatggtggtggtgctggcgcgggagttggcgcaggtggagcaggtggatacgatcagggttatggagccggtgccggtgcaggatccggtgctggagctggcggcgctggtggttacggaggaggtgctggtgcgggagcagatgcaggtgccggtggtgcaggtggatacggaggtggagcaggcgctggagctggcgcgagagctggagctggaggcgttggaggttatggccaatcttatggcgccggcgcaggtgccggagcaggtgttggtgccggtggtgctggagccggaggtgccgatggatatggccagggttatggtgctggagcaggtacaggagctggagatgctggaggatacggaggtggtgctggtgctggagcttccgcaggcgccggaggatatggcggcggagcaggtgctggtggtgttggtgtttatggcaaaggatacggttccggttctggagccggagcagctgccgctgca

SEQ ID NO: 290 - DNA, 396 bp, Artificial Sequence
  Description of Artificial Sequence: Synthetic polynucleotide
ggtgcgggaggtgccacaggtaatcgtgccggcgacgcctttgctcaagtcttttctcaaaatgttataaactctggtgtgataacatcgaccactgttactaagaactccgcgcaggccgcggcctcttcaatggtttccaccgcggctaagagcttaggtttggatgagaacactgcacgatcaatggctaacgctatgtcgtcgtacgctgcagccatggccaaatccttcagaaacagtgacgagttcataagaaatatgtcatatcaaatgggaagaatgctcagtaacgctggagctataaacgagtccactgctagcgcagctgcttcctcagcaagctcgactgtgactgagacggtacgtacttacggcccggccgccatattctca

SEQ ID NO: 291 - DNA, 648 bp, Artificial Sequence
  Description of Artificial Sequence: Synthetic polynucleotide
ggtgccggagctggtggcgctggtggttatgcacaaggttacggagctggtgcaggagcaggtgctggtgccggaacaggtgcaggtggtgctggtggttacggtcaaggttacggagcaggatccggcgcgggtgcaggaggagctggtggatatggtgctggtgctggagccggtgctggagccggagatgcctccggatacggtcaaggatatggagatggagcaggagctggtgctggagctgctgctgcagcaggtgccgctgctggtgctagaggagccggaggctacggaggtggtgctggagctggagcgggtgccggtgccggagctgccggaggttatggacagggttacggtgcaggtgccggagaaggagcaggtgccggcgccggtgccggtgccgttgccggtgcaggagctgctgctgctgctggagcaggtgccggtgctggaggtgccgaaggttacggtgctggcgctggtgctggcggtgccggtggttacggtcagagctacggagatggagccgcagctgcagccggctctggcgctggtgcaggtggatcaggcggatacggtgctggtgcaggcgccggatctggtgctggagcagctggcggttatggtggtggagccggtgca

SEQ ID NO: 292 - DNA, 642 bp, Artificial Sequence
  Description of Artificial Sequence: Synthetic polynucleotide
ggtgtgggtgccggaggagaaggcggttacgaccaaggatatggcgctggagcaggagcaggcagcggaggtggtgctggaggtgctggtggttacggtggaggtgccggtgcaggatctggcggtggagctggtggtgccggtggttatggtggaggcgccggagctggagcaggcgctggcgccggaggcgcaggaggatacggtggtggcgccggagcgggaactggtgcacgcgccggtgcaggtggtgtcggaggatatggacaatcctatggcgccggagcctctgccgctgccggtgcaggtgtaggagcaggaggtgctggtgctggtggagcaggtggttatggacaaggatacggtgcaggtgctggtatcggagctggtgacgccggaggctacggtggtggtgccggagccggtgcctcagctggtgctggaggatatggaggtggtgctggcgcaggagctggaggagttggtggctatggtaaaggttatggagccggttctggagctggagctgcagccgccgctggcgctggagcgggatctgccggtggatatggcagaggagacggtgctggagctggaggcgcttctggctatggccagggttacggcgccggtgccgccgca

SEQ ID NO: 293 - DNA, 699 bp, Artificial Sequence
  Description of Artificial Sequence: Synthetic polynucleotide
ggtgctggaagaggttacggtggtggatatggtggtggtgctgctgctggcgctggtgcaggtgcaggagcaggtagaggatacggtggcggttatggcggtggtgctggtagtggagctggaagcggagcaggtgcaggtggtggctctggatacggcaggggtgccggcgctggtgctggcgcaggagctgctgctgcagccggagctggagctggaggtgctggaggttacggaggtggtgctggtgccggagcaggcgcttctgctgccgctggcgcaggtgcaggagccggaggcgcaggaggatatggaggaggttatggaggaggtgctggagcgggagctggcgcaggtgcggccgctgcagccggtgcaggtgctggtgctggtgcaggacgaggatatggaggtggatttggaggaggtgcgggatcgggtgcaggagcaggagcaggagctggaggtggttcaggatacggtagaggtgctggcggttacggaggtggatacggtggtggagctggtactggtgccggcgcagcagccgccactggagctggtgccggtgctggagcaggaagaggttatggcggaggctacggaggaggcgctggagcaggagctggtgcgggagcaggcgccggaggaggatctggatatggtagaggagcaggtgctggagcgtcagttgctgca

SEQ ID NO: 294 - DNA, 429 bp, Artificial Sequence
  Description of Artificial Sequence: Synthetic polynucleotide
ggtggtcaaggtgaccaaggttaccgagtccaaggcggctacggtcctgttagtaatgctgctgcctcggccgcagctgctgcaagcgctggtggtggtcaaggagcaggacagggaggatatggacccagttctggagctgcagcagcttcagcagctggcgattcgggtggaagaggtggacgacagggttacgttggcggagccggcgcaggtgccggatcgggtgctggcggacaaggaggtcaaggtcagtacggaccaggaacgaatggagctgctgctgccgcggcagcctctgctgcctcagctggaggttccggctctcaagtttctcaggatgtagatcaaggatacggaggaggtgctggtctaggaggctctggatctggttctggtgccgctgctgctgcggcagccgctgctgca

SEQ ID NO: 295 - DNA, 447 bp, Artificial Sequence
  Description of Artificial Sequence: Synthetic polynucleotide
ggtggaggttatggaagaggtcaaggtgctggagctggtgttggagctggagccggtgccgcagctggagcagccgctatcgccagagccggtggttacggtcagggagccggaggatatggtcaaggtcaaggagcaggagctgctgcgggtgccgccgctggagcaggcgctggtggctatggtcaaggtgccggtggttatggtaggggccaaggtgcaggtgcaggagcaggtgccggtgccggtgctaggggttacggtcagggtgcaggtgccggcgctgctgccggagccgctgctagcgctggtgctggaggttatggtcaaggtgctggcggttacggccaaggtcaaggtgccggagctgctgctggcgccgctgcttctgccggagctggcggatacggacaaggtgctggaggatacggtcagggtcaaggagca

SEQ ID NO: 296 - DNA, 444 bp, Artificial Sequence
  Description of Artificial Sequence: Synthetic polynucleotide
ggtgctggagcaggagccggagcaggtgctggtggttatggtcaaggatccggtgctggcgccgcagctggcgcagcagccagtgctggagctggtggctatggccagggtgcaggaggatatggccgtggtcagggtgcttcagcaggtgctggagcaggtgcaggaactggtggatatggacagggagctggtgctggtgctgcagccggagccgctgcgtcggccggagcaggaggctatggtcaaggtgccggtggttatggacaaggaacgggagctggagcaggtggttacggtcaaggaacaggtgccggcgctgccgctggagctggtgcctctgctggagcccgaggctatggtcaacgtgcaggaggttatggtcaaggtcaaggagccggtgctgcagctggagctgccgctggtgccggccgatacggacaa

SEQ ID NO: 297 - DNA, 600 bp, Artificial Sequence
  Description of Artificial Sequence: Synthetic polynucleotide
ggtgctggttatggcgctggtgcgggcgctggtgcaggttacggtgctggtgcaggagccggagccggtgcgggtgcagttgctgcgggtggcgccggcgctggtgcaggaagaggttatggtgcaggagcaggagctggcgcaggtgcagctggaggtgcaggagctggtgcaggtgcaggttatggtgccggcgctggtcgtggatatggtgctggtagtggtgctggagctggcgctggcgctgcaggcggagcaggtgctggtgctggagctggatacggcgccggagctggtgcgggagctggagccgcctcaggagctggagccggtgcaggctatggtgccggagcaggacgtggatatggagcaggagccggtgctggttccggcgccggtgcaggagctggagctgcaggtggcgctggagcaggatacggagccggagctggtgctggagcaggaagtggcgccgctgcagctggtggagcgggagctggagctggctatggagctggagctggtagaggttatggagctggagcaggtgccggttctggtgctggtgctggtgccggtgaagcgggaggagctggtgca

SEQ ID NO: 298 - DNA, 636 bp, Artificial Sequence
  Description of Artificial Sequence: Synthetic polynucleotide
ggttatggagcaggagccggaaggggttacggtgctggagcaggtgccggagcaggcgcagttgccgcatcaggtgctggcgcaggcgctggttacggagcgggagcaggtgcaggagcaggagcaggttacggtgccggagcgggtcgtggatatggtgcaggagccggagcaggtgctggttcaggagctgcctcaggagctggcgccggagccggttacggtgcaggtgccggtgcgggtgctggctatggtgccggagccggaagtggttatggtaccggagccggagctggtgccggagccgcagctgctggaggtgcaggtgcaggcgcaggatatggagcaggagcaggaaggggttatggtgctggagccggagccggtgctgcatccggtgctggtgcaggtgctggagctggtgctgcttcaggagcaggtgctggaagtggttacggagcaggagcagctgcagctggtggagccggcgctggtgctggtggaggttatggtgctggtgctggccgtggttacggagctggagccggtgccggcgcaggcgcaggttctggctcaggttcggcagctggatacggtcagggttacggatcaggtagcggtgctggtgctgccgca

SEQ ID NO: 299 - DNA, 618 bp, Artificial Sequence
  Description of Artificial Sequence: Synthetic polynucleotide
ggtgctgcagccagcggagcaggagctggtggtgctggaggatatggtagaggagctggagcaggtgctggtgccggtgccggatctgctgcaggcaacgcttttgcacaatctctttcttctaacttactaagttcgggagactttgtgcagatgatttcgtccacaacttctaccgaccaagccgttagtgtggcaacctcagttgctcaaaacgtaggaaatcaattgggtctagacgcaaacgcaatgaattctctgctgggagctgtttcaggctacgtatctactttaggaaatgcgatcagtgatgcttccgcatatgctaacgctatatcgtcagctattggaaatgttctggccaactcaggatccatctctgaatctaccgcttcatctgctgccagctcagctgcttcgtctgtgactacgacacttacttcttatggtccagcagtgttttacgcaccaacttcttctgctggcggttacggtggattggttggttatggagctggtgctggagcagctgcaggcgcaggagccggtgccggcggtgctggaggttacatcggccagggtggatatggcgctggtgccggagccgcggccgcagca

SEQ ID NO: 300 - DNA, 435 bp, Artificial Sequence
  Description of Artificial Sequence: Synthetic polynucleotide
ggtggttacggagctggtgctggtgccgttgccgctgctggcgctgctggagctggaggttacggtcgaggcgcaggaggatatggtggtcaaggcggatatggagctggcgccggtgcaggcgctgcagccgccgccggtgcgggtgctggaggagcaggtggatatggacgtggagctggagctggcgcaggagcagccgctggtgcaggagctggcgccggaggagctggctatggcggacaaggtggttacggtgccggagccggtgccggagctgcagcagcagctggagcgggtgctggtggtgccggaggctatggtagaggagcaggtgctggtgctggcgctgccgcaggcgcaggagccggtggttacggtggacagggtggatatggagccggcgctggagcaggtgctgctgcagctgcagca

SEQ ID NO: 301 - DNA, 450 bp, Artificial Sequence
  Description of Artificial Sequence: Synthetic polynucleotide
ggtgctggatcaggcggagccggaggttatggtaggggtgccggtgccggtgccggcgccgccgctggtgcaggagccggtgcaggatcttatggaggacaaggtggttatggtgcgggagctggagcaggtgccgcagctgcagcgggagctggtgctggtgccggtggatacggtcgaggagctggtgccggagctggagctggagccggtgctgctgcaagagcaggagccggagctggaggtgcaggatacggcggccagggtggatatggagccggtgccggtgctggtgctgctgccgctgctggcgctggcgccggtggtgcaggaggatacggtagaggagcaggtgcaggtgctggtgctgcagcaggtgctggagccggagcaggtggttacggtggacaaagcggctacggtgcaggagcaggtgcagctgctgcagca

SEQ ID NO: 302 - DNA, 459 bp, Artificial Sequence
  Description of Artificial Sequence: Synthetic polynucleotide
ggtgctggcgccggcggagctggaggttatggacgaggcgccggagcaggtgccggagctgctgctggagcaggtgctggtgctgctgcaggtgcgggcgcaggtggttacggtggtcaaggcggctacggagctggtgccggagcaggtgctgctgcagctgctggcgccggagcaggaggcgctggaggatacggaaggggcgctggtgctggagctggtgtcgcagcaggtgcaggcgccggaggatacggtggacaaggtggatatggagccggtgcgggagcgggagcagcagctgccgcagctactggtgcaggtggtgctggtggttatggtcgtggagctggtgctggagcaggagctgcagcaggagctggagccggtactggtggcgctggatacggaggtcagggaggttacggagctggcgccggagctggagctgccgctgctgca

SEQ ID NO: 303 - DNA, 483 bp, Artificial Sequence
  Description of Artificial Sequence: Synthetic polynucleotide
ggtgcaggagccggaggagctggttatggaagaggtgctggagcgggagctggagcagcagcaggagctggtgcaggagctgctgccggagccggtgccggagccggtggttacggaggtcaaggtggttatggcgcaggagccggagccggcgctgcggctgctgccggtgccggtgctggtggcgccgctggctattccagaggtggaagagctggagcagccggtgcaggtgctggagcagcagctggtgctggagccggagctggtggttacggtggacaaggcggttacggtgctggtgcaggagcaggtgctgcggctgcggcaggtgcaggatcaggtggtgccggcggatatggtaggggcgccggtgcaggagcggccgctggtgctggtgcagcagccggcgctggagccggtgctggaggatatggaggtcagggaggttacggtgctggagcaggagccgctgcagcagca

SEQ ID NO: 304 - DNA, 537 bp, Artificial Sequence
  Description of Artificial Sequence: Synthetic polynucleotide
ggttatggagcaggtgctggtgcaggtgctggaaccggtggtgccggaggatatggacgcggtgtcggagccggagccggagctggagctggtgccggtggagctggaggatatggtggtggacaaaactacggtgcgggagctggtgctgccgccgcagcaggagcaggcgctggtgcaggtggcgcaggtggctacggaaggggcgccggagcaggagctggcgccgctgctggtgctggtgctggagctgctgctggagctggtgctggtggtgccggaggttacggtacaggccaaggatatggagaaggagcgggcgctggtgccggtgtaggagcaggcggtgcaggtggttacggcagaggtgcaggtgccggtgctggagctggagccggcggatacggtgccggccagggttacggtgctggagcaggagcaggtgctgctgctgcagccggagcaggagccggagccggtggtgccggtggatatggacgtggagctggtgcaggagcaggtgcaggagccgctgca

SEQ ID NO: 305 - DNA, 492 bp, Artificial Sequence
  Description of Artificial Sequence: Synthetic polynucleotide
ggtgccggagcgggaggtgccggaggatacggagccggtcaaggatacggtgccggcgccggcgcaggagcagctgccggagccggtgctggaggagctagaggttacggagcgagacaaggatacggcagtggtgccggtgcaggtgctggagcaagagctggtggagccggaggatacggtagaggagccggagccggtgcagctgccgcctcaggagctggtgctggaggatacggcgctggtcaaggttatggagccggtgctggcgcagtggcctccgctgctgccggtgccggatccggagcaggaggcgctggtggctatggaagaggtgccggagctgtagccggcgctggagctggtggtgctggtggttacggcgctggcgcaggtgctgctgcaggagtaggtgcaggaggaagcggaggttacggtggacgtcaaggcggttattctgctggtgctggtgcgggtgcagcagccgctgca

SEQ ID NO: 306 - DNA, 546 bp, Artificial Sequence
  Description of Artificial Sequence: Synthetic polynucleotide
ggtggtgctggaggatatggtgtaggccaaggttatggagcaggagcgggtgccggcgctgccgcaggtgctggagctggaggcgctggtggatatggtgcaggacagggttacggagctggagccggcgtaggagctgctgctgcagctggagccggagccggtgttggcggagctggcggatatggccgaggagcgggagccggtgctggagcaggtgcaggagcagccgcaggagcaggagcaggtgctgcagccggagctggtgccggcggagcaggtggatatggagcaggacaaggttatggcgctggtgccggtgtaggagcagctgcagctgcaggagctggagctggcgtcggtggagccggtggttacggtagaggcgctggcgcgggagccggagctggagcgggaggtgctggaggttacggcagaggcgctggtgctggcgctggtgctggagccggtgccggtggagcaggtggttatggagctggccaaggttacggagctggtgctggagctggcgctgcagccgcggca

SEQ ID NO: 307 - DNA, 600 bp, Artificial Sequence
  Description of Artificial Sequence: Synthetic polynucleotide
ggtgctggagctggagcaggaggtgcaggcggatacggtagaggtgctggagccggagcgggagctggtgcaggagctggtggagctggtggttacggtgctggccaaggatacggagctggtgccggagctggagccgccgccgctgccggtgcaggagccggtgctggaggagctggaggttacggtagaggagcaggagcaggtgcaggagcaggcgctggagccggaggtgccggtggatacggtgccggacaaggctatggcgcaggtgcaggtgcaggagctgctgctgccgccggagctggtgctggagctggaggcgctggtggttatggaagaggcgctggtgcgggagccggcgctggcgcaggcgccggtggagctggaggatacggaagaggagctggtgctggtgcgggcgctggtgctgccgctggagccggagcaggtggtgctggaagatacggcgccggacaaggttacggtgctggtgctggagcaggcgctgctgccggtgcaggtgctggtggtgcaggaggttatggtgcaggtcagggttatggagctggagctggtgccggtgcagctgctgcggca

SEQ ID NO: 308 - DNA, 558 bp, Artificial Sequence
  Description of Artificial Sequence: Synthetic polynucleotide
ggtgctggtgccggtgtcggaggtgcgggtggatacggaagtggtgctggcgccggagctggtgccggtgcaggagctgcctcaggcgccgcagctggtgctgctgctggtgccggtgccggtggcgcaggcggatacggtacaggacagggttacggtgccggagcaggagccggtgcaggcgccggtgcaggcggtgctggtggatacggtcgaggcgctggtgctggtgccggagctggtgctggtggtgccggtggctatggcgccggtcaaggttacggagccggtgcaggtgctggtgccgctgctgctgctggagatggcgcaggagctggaggcgctggtggttatggtagaggagctggcgccggtgctggcgctggtgcagctgctggagctggagcaggtggtgctggtggatatggagccggacaaggttatggtgcaggtgctggagccggtgctgctgcaggagctggtgcgggaggagctggaggatatggcgctggacaaggatatggtgctggagcaggtgctggtgctgcagccgctgca

SEQ ID NO: 309 - DNA, 546 bp, Artificial Sequence
  Description of Artificial Sequence: Synthetic polynucleotide
ggtgctggtgctggtgtcggtggcgctggtggttatggtagaggcgcaggagcaggtgctggagctgctgccggagcaggagccggtgctgctgccggagctggtgcgggaggagctggtggatacggtactggtcaaggatacggcgctggcgccggagcaggtgcgggtgctggaggtgctggtggttatggaagaggtgctggagctggagctggagccggtgcgggagccggcggtgcaggtgaatatggagccggtcagggatacggagctggagcaggcgcaggagctgctgctgctgctggcgcaggagctggtgccggaggtgctggaggttacggacgaggtgctggtgcaggtgcaggtgcaggagcggctgctggagccggagctggaggtgctggcggttacggtgctcgccaaggttacggagctggtgccggcgctggtgccgctgctggagccggtgcaggtggagcaggtggctacggtgctggtcaaggttatggagctggtgctggtgctggtgcagccgcagctgca

SEQ ID NO: 310 - DNA, 480 bp, Artificial Sequence
  Description of Artificial Sequence: Synthetic polynucleotide
ggtgcaggcgcaggcgctggtggagccggtggttacggtagaggagctggtgccggagccggtgcaggagccggagctgcagcaggacagggatatggttcaggagctggagcaggagccggtgcttctgcaggaggagctggtagttacggaagaggcgcaggagctggagctgcagccgcaagtggagctggtgcaggaggttacggtgccggtcagggatacggcgccggtgccggagccgttgctagcgctgctgccggagctggatcgggtgctggaggcgctggtggatatggtagaggcgccgtagctggatctggtgccggtgctggagccggagcaggtggtgctggaggatacggagcgggagccggtgccggtgctgcagccggcgctgtagccggtggaagtggaggatacggtggtcgtcaaggaggttactccgcaggtgctggcgccggagcagcagccgccgca

SEQ ID NO: 311 - DNA, 576 bp, Artificial Sequence
  Description of Artificial Sequence: Synthetic polynucleotide
ggtgctggtgccggagccggtggagcaggaggattcggacgtggcgccggtgctggcgctggtgccggcgctggcgctgcagctggtgcaggcgccggaggagcaggcggatacggagctggtcaaggatacggcgcaggagctggtgcaggtgccgccgctgctgctggcgctggagcgggtgcgggtggtgcaggtggttacggcagaggtgccggtgccggtgctggtgccggtgctgctgcagctgctggagcgggagctggcggagcaggaggttacggagcgggccagggttatggagccggtgctggagccggagccgcagcagctgctggtgcaggagctggaactggaggagcaggtggttatggcgctggtcaaggctacggagctggagctggcgcgggagctggcgctggagcaggagcaggagcaggtggtgcaggtggatatggtagaggtgcaggagccggcgccggagccggagccggagctggtggagcaggtggatatggcgtaggtcaaggatacggtgctggagcaggtgctggtgcaggtgcaggatccgcagca

SEQ ID NO: 312 - DNA, 384 bp, Artificial Sequence
  Description of Artificial Sequence: Synthetic polynucleotide
ggtaacgcattcgcacagagtttgtcatccaacctcctttcttcaggtgactttgttcaaatgatctcgacaaccacttctaccgaccaagcagttagtgttgcaacttctgttgctcaaaacgtaggaaaccaattgggtctagatgcgaatgctatgaacaacttgttggccgcagttggtggttatgtgtcctcattgggaggtgccgttgcagacgctgctgcttacgccaatgcaattagctcagccatcggtaacgttctcgcaaatacgggctctattaatgaatcaacagcaagttccgcagcttcgagcgccgcttcatccgtcactactaccttgacttcatacggacctgcagtgttctacggaagaggtgca

SEQ ID NO: 313 - DNA, 435 bp, Artificial Sequence
  Description of Artificial Sequence: Synthetic polynucleotide
ggtgctggtgcaggtggcggctatggaggtggatatggtgcaggtggaggagcaggagctggagccggcgcgggtgctggtgccggagccggtgctggtgctggtcgtggtggagcaggaggatatggcgctggagcaggtgccggtgccggtgccgctgccgcagctgctgccggagccggagccggaggaggatatggaggaggatatggtgctggcgttggcgcgggcgctggtgcaggtgccggagctggtggtggttacggaggtggttatggagctggcgctggtgctggagctggtgctgctgctgctgcagctgcgggtgctggtgcaggcggaggttacggtggcggatacggtgcaggcggaggagcaggagcgggagccggagcaggagctggtgcaggtgcaggtgccggtgcaggtagagga

SEQ ID NO: 314 - DNA, 441 bp, Artificial Sequence
  Description of Artificial Sequence: Synthetic polynucleotide
ggtgctgtgggttatggagctggagcaggtgcaggagctgcagcagcggctgcagcgggagctggagctggaggcggttatggtggtggttatggtgctggtggtggtgctggagctggagctggtgcgggagccggtggcggatacggtggtggatatggagctggtggtggcgcaggagccggagctggagcaggcgctggtgcaggtagaggaggtgctggaggatacggtgccggtgctggagcagcagctggtgcagctgctgccgccgcagccggtgctggagctggtggaggctatggaggaggatacggagctggaggtggtgccggtgcaggtgctggagcagctgctggagcaggtgccggcgcaggtaggggaggagctggaggatatggagccggagccggtgcaggagcaggtgcagccgctgctgca

SEQ ID NO: 315 - DNA, 396 bp, Artificial Sequence
  Description of Artificial Sequence: Synthetic polynucleotide
ggttcaggtgctggcgccggttctggatacggcgctggtgctggagctggtgcaggctctggttatggagcgggttctagtgctagtgcaggctctgctattaatactcaaacagttacgagtagtactacgacttcatcacaatcatctgccgctgcaactggtgctggttacggtacaggtgctggcaccggagcctcagctggtgccgcagccagtggcgctggtgccggatacggaggacaagctggatacggtcaaggagctggagctagcgctagagctgccggatccggttacggagctggagcaggcgcggctgcagctgcaggttccggctatggtgctggtgccggtgctggagccggttcgggttatggcgctggagctgctgca

SEQ ID NO: 316 - DNA, 522 bp, Artificial Sequence
  Description of Artificial Sequence: Synthetic polynucleotide
ggtagtggatacggagcaggcgcaggtgctggtgccggcagtggttacggtgccggagccggtgctggaagcggttatggcgcaggagctggagctggtgctggctcaggctacgttgccggagcaggagcaggtgcaggtgctggttctggatatggagctggagcaggcgctggagctggttcctcatattccgctggtgcaggagccggtgctggttctggttatggcgctggtagttctgcttctgccggctcagccgtctcaacacaaactgtttccagttcagcaacgacctcgtcacagagtgccgcagctgctactggagcagcatacggtacccgagcatcaactggaagtggtgcttctgctggagctgcagcatcaggtgctggagctggttacggaggtcaggccggttatggtcaaggaggaggagctgcagcctatagagctggcgcaggatcccaggccgcttatggacaaggtgcctcgggctcatctggtgcggcagctgcagca

SEQ ID NO: 317 - DNA, 504 bp, Artificial Sequence
  Description of Artificial Sequence: Synthetic polynucleotide
ggtgcaggagctggatacggaggtcaagtcggttacggccagggtgctggcgcctcagcaggtgccgccgcagctggagccggcgccggatatggaggacaggctggttacggacaaggagccggtggatccgctggtgcagcagcagctggcgctggtgctggtagacaagcaggttacggtcagggtgcaggagcatctgctcgtgcagcagccgctggagctggcacgggatatggtcagggtgccggtgcatccgctggagccgcagcagctggtgctggtgctggttcccaggtgggatacggacaaggtgctggtgcatcctccggtgctgctgctgctgcgggtgctggtgcaggatacggcggtcaagttggttacgagcaaggcgcaggagcttcagctggagctgaagccgcagcttcatcagctggtgccggatatggtggtcaggccggttatggacaaggcgctggcgcctctgcaggtgcagcagccgca

SEQ ID NO: 318 - DNA, 594 bp, Artificial Sequence
  Description of Artificial Sequence: Synthetic polynucleotide
ggtgccggtgctggatatagaggtcaggccggttacatacagggagctggtgcctctgctggtgcagctgctgctggagctggcgtaggttatggtggacaagccggctatggtcagggcgccggcgcctctgcaggagccgcggccgcagccggtgctggtgctggcagacaagctggatatggccagggcgctggagcatcagctggagctgccgcagcgggagccggtgctggtagacaggcaggttacggtcaaggtgcaggagcctccgccggagctgctgcagcaggagctgatgctggttatggcggacaagccggttacggacaaggagcaggagcttctgcaggcgcagcagcatcaggtgcaggagctggttatggtggccaagctggctatggtcaaggcgctggtgcttctgccggtgctgcagctgctggcgctggagctggctatctaggacaggctggatacggacagggtgctggagcttctgctggcgccgctgccggagcgggtgccggatatggtggtcaggcaggttatggacaaggtactggagcagcagcttctgccgctgcctcaagtgca

SEQ ID NO: 319 - DNA, 537 bp, Artificial Sequence
  Description of Artificial Sequence: Synthetic polynucleotide
ggtggtcctggaggtccaggtggaccaggtggagcttatggtcctggagctggcggacctagcggtcctggaggagcaggtcctggaggtgttggaccttacggtccaggaggagttggtcctggaggagtcggtccgggaggtgcaggagtaggtcctggaggagctccaggtgcaccaggaggcccaggtggccctggaggtcctggaggtcctggtggagtcggaggacctctgggtgcaggtgcaggtggagtcggacctggaggagcgggagcttatggacctggaggtgccggagcatacggacctggaggagtaggacttggtggtgctggcgcttacggtcccggaggagctggaccaggaggcgcaggtccacacggtcctggcggacctggtggagcaggtccaggaggtgaaggacctgtgacagttgatgttgaagtatctgtcggtggcgctcccggaggcggatcaggaggtgttggaccaggaggagcaggagtcggaccaggtggtgctccaggtgcccca

SEQ ID NO: 320 - DNA, 804 bp, Artificial Sequence
  Description of Artificial Sequence: Synthetic polynucleotide
ggtggcgcaccaggtggtggaccaggaggtgccggtccgggcggtgccggatttggacccggaggaggagccggattcggccctggaggaggtgccggtttcggcccaggaggtgctgccggaggaccaggtggtcctggtggacctggaggtccaggtggagctggtggatacggtccaggaggagctggaggatacggaccaggaggtgtcggtcctggtggagctggaggatatggacctggaggtgctggaggttacggtccaggaggttccggtccaggtggtgccggaccgggtggtgccggtggcgagggtccggttactgtagacgttgatgttactgttggacctgaaggagtgggaggaggaccaggtggcgccggtccaggaggtgcaggattcggcccaggtggcggagcgggtttcggtccaggtggcgcccctggagccccaggaggaccaggaggtcctggaggaccgggtggtccaggaggtccaggaggtgtaggaccgggtggagctggaggttacggccctggtggtgctggtggagtaggaccggctggtactggaggattcggtcctggaggagccggtggttttggacctggtggagcaggaggttttggtcctggaggagcaggtggattcggaccaggaggtgctggaggatatggtccaggtggtgttggtcctggtggtgcaggaggttttggacctggaggagttggtccaggaggatcaggacccggaggagctggtggtgaaggaccagtaacagtagatgtagacgtctcagta

SEQ ID NO: 321 - DNA, 804 bp, Artificial Sequence
  Description of Artificial Sequence: Synthetic polynucleotide
ggtggagctcctggtggtggtccaggaggagctggtcctggtggagccggatttggtccaggtggtggcgcaggttttggcccaggtggtggagctggatttggaccaggcggagctgctggcggtcctggtggtccaggtggaccaggaggtccgggaggagcaggaggttacggaccaggtggcgccggaggctacggaccaggcggcgttggtccgggtggcgctggtggatacggacccggaggagctggaggatatggtccaggaggttctggacccggcggcgccggtcctggaggagcaggtggagagggacctgtgactgtagacgtggatgtgacagttggtcctgaaggtgttggaggaggcccaggaggtgcaggccctggaggtgccggtttcggtccaggtggtggtgcaggattcggacctggcggtgcaccaggagccccaggtggcccaggtggtcctggaggtccaggaggacctggtggacctggtggtgttggacctggaggtgcgggcggttatggaccaggtggagcaggaggagtaggaccagcaggtactggtggctttggccctggtggtgccggtggtttcggcccaggaggtgctggtggtttcggacctggtggtgcaggaggatttggtccagcaggtgctggcggttacggacctggtggagttggacccggcggtgctggaggattcggaccgggaggagttggcccaggtggttcgggtcctggtggagctggaggagagggtcctgttaccgtcgatgtagacgtttctgta

SEQ ID NO: 322 - DNA, 804 bp, Artificial Sequence
  Description of Artificial Sequence: Synthetic polynucleotide
ggtggtgcccctggtggaggaccaggtggagctggcccaggaggtgctggttttggaccaggtggaggagctggatttggacctggtggtggagccggcttcggaccaggtggagcagccggtggtccgggtggtccaggaggtccaggtggaccaggaggagctggtggttatggccctggaggtgctggaggatatggtccaggcggtgtgggtccaggtggagctggtggctatggtcccggtggcgctggcggatacggaccaggtggaagcggccctggaggcgccggaccaggtggtgccggtggtgaaggaccagtcaccgtcgacgtagacgttactgttggacctgagggagtcggtggaggacccggcggtgccggtccaggaggcgccggtttcggtccaggaggaggtgccggtttcggccctggtggagccccaggagctccaggcggccctggaggtccgggaggtcctggaggaccaggaggtccgggtggcgttggaccaggtggtgcgggaggttatggtccaggtggagccggtggatttggtcctggaggcacaggcggatttggacctggaggcgctggtggttttggacctggtggcgcaggaggatttggtcctggcggtgccggaggattcggtcctggtggagctggaggatacggtccaggaggtgttggtccaggaggtgctggaggtttcggaccaggcggtgttggacctggaggaagtggtcccggcggtgccggaggtgaaggcccagttactgtggatgtcgacgtttctgta

SEQ ID NO: 323 - DNA, 570 bp, Artificial Sequence
  Description of Artificial Sequence: Synthetic polynucleotide
ggtgttagttacggacctggaggtgcaggtggtccttatggtccgggtggtccttacggaccaggtggagaaggtccaggtggagcaggaggaccttatggccctggtggtgttggaccaggaggcagtggtcctggaggttacggacctggtggagcgggcccaggaggatatggacctggcggatctggacctggcggatatggacctggtggatcaggacctggaggttatggcccaggaggaagtggtccaggcggatacggacctggtggttccggtccaggtggttacggaccaggaggatatggcccaggtggatctggtccgggcggatcgggacctggaggtagcggacctggaggatatggtcctggcggtactggtccaggtggttcaggcccgggaggttacggtcctggaggttcgggtccaggaggatctggtccaggcggttatggtccaggtggtagtggacctggaggatttggaccaggtggttccggacctggaggttacggtccaggaggatcgggtcctggaggcgcaggaccaggtggagtaggtcca

SEQ ID NO: 324 - DNA, 690 bp, Artificial Sequence
  Description of Artificial Sequence: Synthetic polynucleotide
ggtggatttggaccaggtggtgctggacccggaggcgctgcaccaggtggtgccggtcctggcggtgccggtccaggtggagccggccctggaggcgccggtccaggaggcgccggtcctggtggcgcgggtccaggtggagctggaggtgcaggaggtgctggtggcagcggtggtgccggaggatctggtggtactacaataattgaagatctggatatcacaattgacggcgcggatggccctattactatttctgaagagcttcctatttctggagccggtggatctggtcctggtggcgctggtcccggaggagttggaccaggaggatctggaccaggcggagttggtccaggtggttccggtccaggcggagttggacctggtggttcgggccctggaggtgtgggtccgggcggtgctggaggcccctatggtccaggaggatccggtcctggcggagctggtggagcaggaggtccaggtggtgcttatggacctggaggatcctacggacccggaggttcaggtggtccaggaggagcaggaggcccttatggtcctggaggagagggtcctggaggcgctggtggtccttacggtccaggaggtgcaggtggtccttatggtccaggtggagcaggcggtccatacggaccaggaggagaaggcggtccatatggccca

SEQ ID NO: 325 - DNA, 630 bp, Artificial Sequence
  Description of Artificial Sequence: Synthetic polynucleotide
ggtggatcttacggacctggaggcgctggcggaccatatggacctggcggtccatatggtccaggtggagagggacctggtggtgctggtggaccatatggaccaggaggtgtcggtccaggaggaggaggtcctggcggttatggacctggtggcgcgggacctggaggctacggaccaggtggatctggtcccggcggttacggaccaggtggtagcggccctggtggatatggtcctggtggctccggtccgggtggttatggtccaggtggttctggccctggtggttatggaccaggtggttccggtccaggtggctcaggccctggaggatacggacctggtggctcaggtcctggaggaagcggacctggtggctatggcccaggaggtagtggtcccggcggatatggtcctggaggatcgggaccaggtggctcaggaccaggaggttatggtcctggaggttcgggacctggtggttctggtccaggtggttacggaccaggaggatcaggacctggaggattcggtccaggaggatttggaccaggaggctcaggaccaggtggatacggcccaggcggttctggtccaggaggcgccggcccaggtggtgttggtcca

SEQ ID NO: 326 - DNA, 699 bp, Artificial Sequence
  Description of Artificial Sequence: Synthetic polynucleotide
ggtggatttggtccaggtggcgcaggccctggaggtgcaggccctggtggagcaggtcctggtggagctggccctggaggtgccggccctggaggagcaggtccaggtggcgctggacctggcggcgctggacctggtggagccggtggtgctggcggtgctggcggtgccggaggatcaggaggcgcgggaggcagcggtggaactactattatcgaagatttagacatcaccattgatggagctgatggccctatcacaatttccgaagaattgactatatccggtgcaggtggcagtggaccaggaggagctggtcctggtggagttggaccaggtggaagcggacctggtggtgttggcccaggtggtagtggtcctggaggagttggtccgggaggatccggacccggaggtgtcggtcctggtggagccggaggtccatacggaccgggtggatccggacctggcggcgccggtggagctggaggacctggtggtgcatatggaccaggtggatcctatggaccaggaggaagtggtggccccggtggagctggtggcccatacggaccaggaggcgaaggaccaggtggagcaggtggcccttacggaccaggtggtgccggaggtccttacggtcctggtggcgccggaggtccatatggtccaggcggtgaaggtggcccttatggtcca

SEQ ID NO: 327 - DNA, 540 bp, Artificial Sequence
  Description of Artificial Sequence: Synthetic polynucleotide
ggtggtagctatggtccaggtggagctggaggtccttacggaccaggtggtccatacggccctggtggagaaggtccaggaggtgccggtggtccttatggacctggcggagttggcccaggtggaggcggtccaggaggttacggtccgggaggtgccggaccaggcggatacggacctggcggatcaggaccaggtggatacggccctggaggctcaggaccaggaggatacggcccaggtggatccggccctggtggttacggccctggaggatcaggacctggtggatatggtccaggtggtagtggtcctggtggttcaggacctggaggttacggtccaggtggttccggtccaggaggctatggtccaggaggatccggtcctggaggatccggaccaggcggctatggacctggaggttcaggtccaggtggattcggacctggaggttttggacctggaggatcaggtccaggaggttatggtccgggaggatcgggtcctggtggtgctggaccaggaggtgtaggacca

SEQ ID NO: 328 - DNA, 699 bp, Artificial Sequence
  Description of Artificial Sequence: Synthetic polynucleotide
ggtggttttggacctggtggagctggaccaggaggagccggacctggtggtgcaggcccaggaggagctggaccaggtggtgctggtccgggtggtgccggtccaggaggtgctggtcctggtggagcgggtccaggtggagcaggaggtgctggtggagctggaggagctggaggtagcggtggtgcaggaggttctggaggaacaaccatcatcgaagatttagatatcactatcgatggagctgacggcccaatcacaatatccgaggaacttacaatctctggagccggtggatcaggtccgggtggtgctggacctggtggtgtaggacctggtggatcaggaccgggtggtgttggacccggaggtagcggtccaggaggcgttggtcctggtggctcaggagccggtggagtgggtccaggaggtgccggaggaccttatggtcctggtggatctggaccaggtggagctggaggcgcaggaggacctggaggtgcctatggtcctggaggttcgtacggaccaggtggatcgggtggtcctggaggagcaggaggaccttacggtcctggtggtgaaggtcctggaggtgctggtggtccatacggcccaggtggagctggtggtccttacggacctggtggagccggaggtccttatggtccaggtggtgaaggaggaccatacggccca

SEQ ID NO: 329 - DNA, 855 bp, Artificial Sequence
  Description of Artificial Sequence: Synthetic polynucleotide
ggtgcaggtggttcaggaccaggtggtgctggtccaggaggcgctggcccaggtggagctggacctggtggtgccggacctggtggcgctggtcctggaggagttggaccaggcggtgccggtggacctggaggtgctggtggtccatttggtcctggaggttctggacctggcggagctggaggagcgggtggtccatacggtcccggtggagcgtatggccctggaggaccaggtggaccaggaggaccaggcggaccaggttctggtggaccatacggaccaggaggtgcctatggtccaggtggagcttacggtcctggcggtgcttacggaccaggtggtgcaggcggaccaggtggagcaggtggcccatacggtcctggaggtccttatggacctggcggaccatatggacctggtggtgcaggtggtccaggcggagctggtggtccatatggcccaggcggagcaggtccaggaggatatggccctggcggagcaggaccaggaggttacggacctggtggaagtggtccaggtggtgcgggtccaggtggatatggtcctggtggatccggtcctggaggtgccggacccggaggctatggtccaggcggtgctggacctggaggatatggcccaggaggagctggtccaggaggtgcaggtccaggtggagccggtccgggaggatatggacctggcggaagcggtccaggtggtcctggtagtggtggtcctggtggtgctggtggttctggtggtactactgtcatcgaggacctggatattactgtaaatggcccaggcggacctattaccattagcgaagaattgaccgtcggaggccca

SEQ ID NO: 330 - DNA, 807 bp, Artificial Sequence
  Description of Artificial Sequence: Synthetic polynucleotide
ggtgcaggtggctcaggccctggtggagcaggacctggaggtgccggtcctggaggcgctggacccggcggtgttggaccgggaggagctggaggacctggtggagccggcggtccatttggaccaggtggttccggaccaggtggcgctggtggcgctggtggtccatacggccctggcggagcttatggtccaggtggccctggtggtccaggtggtcctggtggcccaggctctggtggtccttacggaccaggtggagcttacggaccgggtggagcatatggtccaggaggagcatatggaccaggcggagccggaggtccatacggaccaggtggtccttacggccccggaggaccttacggtcccggtggtgcaggtggacccggaggcgccggtggtccatacggacccggtggtgctggtccgggtggatacggtccaggaggcgcaggtccaggaggttatggaccaggcggttctggacctggaggtgcaggacccggtggatatggacccggtggatccggacctggcggagccggacctggtggatatggacctggtggtgcaggtccaggcggttacggacctggtggcgctggacctggcggtgctggtcctggaggtgctggacctggcggatatggcccaggtggttctggtcctggaggacctggttcaggaggaccgggtggagccggaggatcaggcggtacaacagtcatcgaagatttagatattaccgtcaacggcccgggcggaccaatcacaatttctgaagagttgactgtaggaggtcca

SEQ ID NO: 331 - DNA, 864 bp, Artificial Sequence
  Description of Artificial Sequence: Synthetic polynucleotide
ggtgcaggtggatctggtccaggaggtgccggtccgggcggagctggtccaggcggcgcaggaccaggcggtgctggtcctggcggtgctggtcccggaggagttggacccggtggagctggtggtcctggtggagctggaggtcccttcggacctggaggaagcggaccaggaggagcaggaggtgcaggaggaccttacggaccaggtggcgcctatggacctggcggtccaggaggccctggaggacctggcggaccgggtggccctggatccggtggaccatatggcccaggtggtgcgtacggccctggtggagcatatggtcctggaggagcatatggaccaggtggtgctggtggacctggcggcgcagcaggtccctacggaccaggcggaccatatggtccaggtggtccgtacggaccaggtggtgcaggcggacctggtggtgctggaggaccatacggtcctggaggtgcgggacctggcggttatggtccaggcggtgcaggtcctggcggatatggtccaggtggatcaggaccaggaggagccggacctggaggatatggacctggtggttcaggtccaggtggagccggacctggtggatacggccctggtggtgccggacctggaggctacggacctggaggagctggcccaggaggtgccggaccgggtggagctggacctggtggttacggtccaggaggttctggtccgggtggtcctggtagtggaggaccaggtggtgccggtggaagcggtggcactacagttattgaagatctagatattaccttaaatggacctggaggtcctataacgatctccgaagagctgactgtaggaggacca

SEQ ID NO: 332 - DNA, 531 bp, Artificial Sequence
  Description of Artificial Sequence: Synthetic polynucleotide
ggtgcaggtggttctggcccaggtggtgctggtccaggaggagtgggaccaggacgttcaggccctggaggtgttggaccaggaggctctggtccaggttctgttggtcctggaggatctggacaaggaggtttgggcattggtagaagtggccctggcggtgttggcccaggtggttcaggaccaggatctattggacctggaggtagcggtcagggaggtcttggtcctggtggttcaggtcagggtggtttgggcccaggaggttcaggacctggaggagttggctccggcggagttggaggaccatacggtccaggtggatctggcccaggaggagtgggtggagcaggaggaccatatggtccgggcggtagcggtggaccaggtggagctggaggaccatatggacctggtggaccttatggtcctggtggtgctggaggaccttacggccctggcggagcaggtggaccttacggaccgggtggtccatacggccctggtggtgctggcggtcctggtggagga

SEQ ID NO: 333 - DNA, 573 bp, Artificial Sequence
  Description of Artificial Sequence: Synthetic polynucleotide
ggtccaggaggtgccggtggtccatatggaccgggaggaccaggtggcgcgggtcctggtggctacggtccaggaggatatggaccaggtggtgctggtccaggtggagcaggaccgggaggctatggaccaggtggagccggtcctggaggatatggtccaggaggtgcaggtcctggcggtagcggtcctggtggcataggtccaggtggatccggaccaggaggatacggtccaggtggaattggcccgggaggaactggccccggtggtgctggacctggtggtgcaggtccaggtggtgctggcccatccggtgctggtcctggtggcgctggtccatcaggtgccggaagaggtggttccggtaggggttcggttggccgaggtggcgccggcagaggtggagccggtagaggaggtgcaggaggagcaggcggatccggaggcgcaggtggctctggcggtgccggcggatctggaggaacaacaatcatcgaggaccttgatattaccgttgatggagctaatggtccaattactattagtgaagaactaactataggtggtgca

SEQ ID NO: 334 - DNA, 585 bp, Artificial Sequence
  Description of Artificial Sequence: Synthetic polynucleotide
ggtgccggaggtgtaggtcccggaggttctggcccgggaggtgtaggacctggcggatcaggacctggtggtgtcggacctggaggatccggtccaggcggagttggctctggaggatcaggacctggaggtgttggacctggtggatccggtcctggcggtgtcggatccggaggtttcggtccaggtggtattggaccaggaggtagtggtcccggtggagttggtcctggaggagtcggaggaccatatggaccaggcggatcaggccctggtggagctggtggagcaggcggatcttacggtccaggcggaccatatggcccaggcggtagtggaggacccggtggtgccggtggaccatatggtccgggaggtgcaggaggcccttacggaccgggaggaccttatggtcctggaggagcaggtggtccaggtggcgagggaccgggtggcgcgggaggtccgtatggaccaggaggaccaggaggtgccggtcctggtggttatggtcctggtggtgctggtcctggaggatatggacctggaggagctggcccaggaggttacggacctggtggtgca

SEQ ID NO: 335 - DNA, 648 bp, Artificial Sequence
  Description of Artificial Sequence: Synthetic polynucleotide
ggttctggaggttacggaccaggtggtgcaggtccaggaggctatggacctggtggccctggacctggtggctatggtccaggtggtgcaggccctggtggttacggaccaggaggtactggacctggtggatccgccccgggcggtgcgggcccaggtggtgctggcccaggtggatacggtcctggaggttccggtccaggtggttatggaccaggtggtggaccaggaggtgccggcccaggtggagcaggtccaggaggtgctggccctggcggagcaggtcctggaggtgccggccctggaggtgccggtcctggtggagctggtccaggaggtgccggacctggtggagccggccctggtggagctggcccaggaggagtgggaacaggtggactgggaagaggcggagctggaaggggaggagctggaagaggaggtgccggtcgaggaggtgccggacgaggaggtgcaggtcgtggtggaacaggtggagttggtggagccggtggcgctggaggagctggtggtgtcggtggagctggtggatccggaggtactaccgttattgaagatttagacataactattgatggtgccgacggtccaattacaatatctgaggagttgacaatttccggtgca

SEQ ID NO: 336 - DNA, 594 bp, Artificial Sequence
  Description of Artificial Sequence: Synthetic polynucleotide
ggtgccggaggaagtggtccaggaggtgcaggtcctggaggtgtcggtccaggtggatcaggacctggaggtgttggtcctggaggttcaggccctggtggtgttggtccaggaggagcgggcggtccatataggccaggcggatctggacctggaggagcaggaggtgcaggtggtcctggcggagcatatggtccaggaggatcaggaggtcctggtggagctggtggcccgtacggccctggtggagaaggtccaggtggcagtggcggcccatacggaccgggaggagaaggaccaggtggtgctggaggcccatatggtccaggcggcgctggcggtccatacggtccaggaggagctggaggaccatatggtccaggtggagctggtggaccatatggcccaggtggtgccggtggcccttatggaccaggtggagccggtggcccatacggccctggtggtgcaggaggaccttatggacctggtggagagggtccaggtggagcaggtggtccttacggacctggaggagttggtccaggtggaaccggtccaggaggttatggtcctggcggtgccggcccagga

SEQ ID NO: 337 - DNA, 624 bp, Artificial Sequence
  Description of Artificial Sequence: Synthetic polynucleotide
ggttatggacctggaggatccggtccaggaggctacggccctggtggttctggtcctggtggttttggaccgggtggatctggaccaggtggatacggacctggtggaagtggaccaggaggatacggtccgggaggttctggacctggtggtgctggacctggtggttacggacctggaggaaccggtcctggaggatcaggacctggtggatacggtccaggaggtagcggacctggtggatatggtcctggtggtagtggaccaggtggttatggccctggaggatcgggcccgggtggtgccggtccaggtggcgctggaccaggtggagccggacctggtggagctggaccaggaggagttggtccaggtggtgcaggtcctggaggatctggacctggcggagctggtccaggaggagcaggaagaggtggagcaggccgtggaggcgcaggtcctggaggtgctggacccggtggagctggtggagcgggtggagccggaggatccggtggagcaggcggaagcggaggaactaccgttatagaggacctggatataactattgatggagctgacggacctatcacaatctcagaagagttgactattaatggcgca

SEQ ID NO: 338 - DNA, 549 bp, Artificial Sequence
  Description of Artificial Sequence: Synthetic polynucleotide
ggtgctggtggttctggaccaggaggcgccggccctggtggtgtaggccctggtggatcgggaccaggtggagtaggaccaggtggaagtggaccaggcggagtgggaccaggtggagctggaggtccttatggacctggaggctctggacctggcggagctggtggtgctggcggccctggaggagcatacggtccaggcggttcgggtggtccaggaggagctggcggaccttatggtccgggaggcgaaggaccaggtggtgctggtggaccatacggtcctggaggtgaaggtcctggaggtgctggaggtccatacggtcctggtggtgcaggaggaccatatggtcctggaggtgccggtggcccttacggccctggaggtgcaggcggtccatacggtccaggtggcgctggaggtccatatggcccaggaggtgttggaccgggaggaactggtccgggtggctacggacctggcggtgctggtccaggcggttatggtcctggaggatcaggtcctggaggttacggtccaggaggatca

SEQ ID NO: 339 - DNA, 603 bp, Artificial Sequence
  Description of Artificial Sequence: Synthetic polynucleotide
ggtcctggtggatatggacctggcggttcaggaccaggaggatttggaccaggtggttctggtcctggaggatctggtccaggtggctcgggtcctggaggatatggtcctggaggttctggtccaggtggatacggtcccggtggttctggcccaggtggttacggaccaggcggatctggtccaggaggctatggtccaggtggatccggaccaggaggaagtggccctggaggatacggtccaggtggaagcggaccaggtggttatggacctggtggatccggacctggaggagcgggacctggaggtgctggcccaggtggagtcggtccaggaggtgcaggtcctggcggagccggtcctggtggagttggtcccggtggcgctggtcctggtggtgctggaccaggtggtgcaggacctggtggagctggccgtggtggtgccggaccaggcggtgctggtggtgccggtggagctggtggatctggtggagctggtggtagtggtggaactacagtaattgaggatttggatataaccatcgacggtgctgatggaccgattactattagcgaagaacttaccatcggtggtgca

SEQ ID NO: 340 - DNA, 624 bp, Artificial Sequence
  Description of Artificial Sequence: Synthetic polynucleotide
ggtatcaatgtcgattccgacataggttctgtaacctcgctcatactgtcaggtagcactctacaaatgactataccagccggtggtgatgatcttagcggaggttaccctggaggattcccagctggagcacaaccgagtggtggcgctcctgttgatttcggcggaccatcagctggcggtgacgttgctgcaaagctggctagatctttggcatctacattggcctcatcaggtgttttcagagcagcgtttaattccagagtatcaacacctgttgctgttcagtttacagatgccctagtgcagaaaatcgcctccaatcttggactggattacgctacggctagtaagctgcgaaaggcatcccaggctgtctccaaggtcagaatgggaagtgacactaacgcctacgccctggctatttcttcagctttagctgaagtattgtcctcatccggaaaagtcgcagacgctaatattaatcagattgctcctcagctagcctcaggtatcgttttaggagtttctactacggccccacagtttggagtagacttgagctcaattaatgttaatctcgacatttccaatgttgctcgcaatatgcaagccagcatacaa

SEQ ID NO: 341 - DNA, 504 bp, Artificial Sequence
  Description of Artificial Sequence: Synthetic polynucleotide
ggtggtccagccccaattaccgctgaaggcccagatttcggtgcaggatatccaggaggagctcctacagatttgagtggattggatatgggtgctccctccgatggctctcgcggaggagatgctaccgccaaactattgcaagctctagttccagcactgcttaaatccgatgtgtttagagcaatctacaagagaggcactagaaaacaagtcgtacagtatgtcactaattctgctctccaacaagccgcctcttcacttggtctggatgcatcaacaatatctcagctacagacaaaggctactcaagctttgtctagtgtgagcgctgattctgactctaccgcatacgctaaggcctttggtttggcaattgctcaagtgttgggaacctctggacaagtaaacgatgcaaatgttaaccagattggtgccaagttagccactggtattctcagaggatcttccgctgtcgcccccagactgggtattgacctgtca

SEQ ID NO: 342 - DNA, 624 bp, Artificial Sequence
  Description of Artificial Sequence: Synthetic polynucleotide
ggtatcaacgtcgattcagatataggatccgtaacatctcttatcttaagtggttctactttgcaaatgaccattccggcaggaggagatgacctgagcggtggatatcctggtggatttccagcaggagctcagccatctggtggtgctccagtagattttggaggaccatcggcgggtggtgacgtcgctgcaaaacttgcccgttctctcgcttcgaccctggcctccagtggagtatttcgtgctgctttcaacagcagagtttcaactccagttgcagtgcaactgaccgatgcgttggtccaaaagatcgcctcaaatcttggcttggattacgctactgcatcgaagctccgtaaggcatctcaggctgtttctaaggtccgcatgggatcagatactaacgcatacgctttggctatctcatcagcattggcagaggttttgagttcctcaggtaaagtcgctgacgccaacattaatcagatcgctccgcaacttgcttctggaatcgtcttaggcgtttcgaccacagcacctcaatttggagttgatttaagttctataaacgtgaacttggatatttccaatgtcgctaggaacatgcaagccagcatacaa

SEQ ID NO: 343 - DNA, 504 bp, Artificial Sequence
  Description of Artificial Sequence: Synthetic polynucleotide
ggtggacctgctccaatcaccgctgagggtccagactttggagctggatacccaggtggcgcccctactgaccttagtggattggacatgggtgccccttcagatggatcgcgcggtggtgatgcaaccgctaaattgcttcaagctttagtgcccgcacttctaaaatccgatgtattcagagcaatatataagagaggaacgagaaaacaagtagttcaatacgttacgaactcggcgttacaacaagctgctagttctttaggtttggatgcctccacgatttcccagttgcaaactaaggccacccaagccttatcttcggttagcgctgactccgattctactgcctatgccaaagcttttggactggccattgctcaggtactaggaacttcaggtcaggttaatgacgctaacgtgaatcaaatcggagcaaaactcgcaactggtattttgcgtggatcatctgctgttgctcctagattgggaatcgacctatca

SEQ ID NO: 344 - DNA, 624 bp, Artificial Sequence
  Description of Artificial Sequence: Synthetic polynucleotide
ggtatcaacgttgattccgatattggaagtgtgactagtctgattttgtccggctccacattgcaaatgaccattccagccggtggtgacgacctgagcggaggttacccaggcggattgcctagcggcgctcaaccaagtggtggtgctcctgtggattttggtggaccatctgcaggtggagatgtcgcggcgaaactggcgagatcattggctagcactttggcctctagtggtgtttttagggcagctttcaactcccgtgttagcacacctgttgctgtccaactaacagatgcactggtgcagaagatcgcaagtaatttaggacttgattacgccaccgcctcaaaattgagaaaagcatctcaggctgtatctaaggtgcgcatgggttctgacacaaatgcatacgcactggctatttcttcagccttggctgaagtgctatcaagttccggaaaggtcgcagacgccaatattaaccaaattgcaccgcagctagcatctggaatcgttttgggtgtcagtaccactgcaccccaatttggtgttgacctatcttcaattaatgttaacctggacatctctaacgtggctcgcaatatgcaggcatccattcaa

SEQ ID NO: 345 - DNA, 504 bp, Artificial Sequence
  Description of Artificial Sequence: Synthetic polynucleotide
ggtggtccagcacctattaccgctgagggtcctgactttggtgcaggatatcccggtggcgcacctactgacttaagcggactcgatatgggagctccatctgatggatccagaggaggtgacgccacagccaagctattacaggccctcgtaccagcgcttctaaagtctgatgtttttagagccatatacaagagaggaactcgtaagcaagttgtgcagtacgtaactaactcggctcttcaacaagcagcgtcgtcgctaggtctagacgccagtaccatttctcagttgcagactaaagccacgcaagctttgtcatcagtatcagctgattcagactctaccgcttatgctaaggcttttggactggcaatcgctcaagttttgggtacctcaggccaagtgaacgacgctaacgttaatcagataggtgctaaattggcaactggcatattaagaggtagcagcgctgtcgcgcctaggctgggcattgacttgtca

SEQ ID NO: 346 - DNA, 624 bp, Artificial Sequence
  Description of Artificial Sequence: Synthetic polynucleotide
ggtatcaacgtcgacagtgatattggaagtgtaacgagcttgatcttgagcggtagtaccttacaaatgactatccctgccggtggtgacgacctcagcggtggctacccaggaggattcccagctggagctcagccttcaggaggtgctccagtcgattttggaggaccatctgctggaggtgacgtcgctgctaaattggccagatctctggcctcaactctggcatcgtctggagtatttagagcagcatttaattccagagtatccacacctgttgctgtacaactgacagatgctctcgtccaaaagattgctagcaatcttggactagactatgctactgcctcaaagttgagaaaggcgagtcaagctgtcagcaaagttagaatgggttctgatactaatgcctatgcactagcgatcagctccgcattagccgaggttttgtcatcttcgggtaaggtcgccgatgcaaacattaaccaaatcgctccacaattagcttctggaattgtgctaggagtcagtaccacagctcctcaattcggcgtggatttatcatctattaatgttaaccttgatatatcgaatgtcgcgaggaacatgcaagccagcattcaa

SEQ ID NO: 347 - DNA, 504 bp, Artificial Sequence
  Description of Artificial Sequence: Synthetic polynucleotide
ggtggtccagcaccgattacagctgaaggacctgatttcggtgctggatacccaggaggagctccaaccgatctaagcggcctcgacatgggagccccatctgacggttctagaggtggagacgctacagccaaactattgcaggctctcgttcctgccttactaaagtctgacgtttttagagcgatatataagagaggtacacggaagcaagtggtgcaatacgttaccaactccgctttgcagcaggctgcttcttcgttgggtttagacgcatccactatttcacaattgcagacgaaggcaacacaggccctttcctctgtcagtgccgattcggatagcaccgcctacgcaaaggctttcggtttggctattgctcaggtgctaggtacttctggacaagtcaacgacgctaatgtgaatcagattggagctaaattggctaccggtattcttagaggatcttctgccgtagcccctagattgggcatagacctttca

SEQ ID NO: 348 - DNA, 624 bp, Artificial Sequence
  Description of Artificial Sequence: Synthetic polynucleotide
ggtattaacgtcgattcagacatcggttctgtgacaagtttaatattgtctggttccactttgcaaatgaccataccagctggcggtgacgatctgagtggcggctaccctggcggattcccatctggtgctcaaccttccggaggagctcctgttgattttggaggtccatctgctggtggtgatgttgcagctaaattagcacgatctctagcatctacgttggcatcgtccggcgtatttagggcggcttttaactctagagtgtcaacacctgttgctgtacaattaaccgatgctctcgtgcagaagatcgccagtaacctgggtttggactatgcaactgcttcgaaactaagaaaggcttctcaagcggttagcaaggtccgcatgggctccgacaccaacgcctatgcattggcgatatcaagtgcactcgctgaggttttgttgagctctggaaaggtagcagacgccaacattaaccagatcgctcctcaactcgcctcaggcatagttttaggtgtttctactgcagcaccacagtttggcgttgacttatcaagcattaatgtgaacctggatatctctaacgtggccagaaacatgcaagcaagcatacaa

SEQ ID NO: 349 - DNA, 504 bp, Artificial Sequence
  Description of Artificial Sequence: Synthetic polynucleotide
ggtggacctgccccaataacggctgaaggacctgattttggtgctggttaccctggcggtgcacctactgatctgtcaggactggacatgggtgccccatccgacggcagtaggggaggcgacgctacagctaaactattgcaggctctggtgccggcgctgttgaagagtgacgtttttagagctatttataaaagaggtacacgaaaacaagtcgtgcagtatgtcactaattctgctttacaacaggccgcatcttccttgggcctggacgcttctactatatcccagttgcaaacaaaagcaacccaagcattgtcctccgtttctgctgattccgactctacagcatatgctaaagcatttggtttggcaattgcccaagttctgggtactagcggtcaggtaaatgatgctaacgtaaatcagatcggagcaaaacttgccaccggtatattgagaggttcctcagctgttgcccctagactaggaattgatttgtca

SEQ ID NO: 350 - DNA, 645 bp, Artificial Sequence
  Description of Artificial Sequence: Synthetic polynucleotide
ggttcttccgccggacttgtaagcagagtcgcaaatgcattggctaacaccagtacattacgcgctgttctgcgaaggggtgtaagtcaacagactgcttcctccgtcgtgcagagagccgttcaatcccttgccggaacgctaggagttgatggaaattccttgtccagaattgccctgcaagcaattagtcaattgcctggtggtagtgatacttctgcatacgcccaggctttctcatctgctttattcaacgcaggtgtattgaacgcttcaaacatagacactttgggttcgagggttttgtctgccgttctgaacggtgtctcttctgccgcccaaggtattggactcaacgttgatacaggttctgtacaaagcgacatttcttctagttcatcttttttatcaagtagtagttcgtcggcaagtttcagccaaacctccgcttcgagcacctctggtgccggttatacagccccagctggaccgtctggatacactggtccttccggaccatccggatacacgggtccggtaggaggtgctgctcaatttggatctgtttcaggtcaaacatctttcggacaaacatcaggatttactgcaagtaccggcggacaggctgctttcggtgcaacctca

SEQ ID NO: 351 - DNA, 645 bp, Artificial Sequence
  Description of Artificial Sequence: Synthetic polynucleotide
ggttctagtgccggattggtcagtagagtcgctaatgcattagctaatacaagtacattgagagcggtcttgcgaagaggcgtatctcaacagacagcctcctccgtggtccagagagctgtccaatctcttgcaggcacgttgggagttgacggaaacagtctttcaagaattgctttgcaagctattagtcaattgccagctggtagtgacacttcagcatatgctcaagcgttcagttccgcattagttaatgctggtgttttgaacgcctctaacattgacacattgggttcacgcgtcctaagtgcagtgcttaacggcgtttcatccgctgcgcaaggaataggattaaacgtcgataccggcagtgtccagtctgatatctcaagttctagctcttttttgtccagttcgtcgtccagtgcttctttttcacagaccagcgccagtagcactagcggcgctggttatactggacctagtggaccttcaggatatacaggtccagccggtccatccggatataccggtcctgttggcggtgctgctcagttcggttcggtaagtggacagacttctttcggacaaacctctggttttacagcttctacgggaggacaggccgccttcggtgctacttca

SEQ ID NO: 352 - DNA, 645 bp, Artificial Sequence
  Description of Artificial Sequence: Synthetic polynucleotide
ggttcttcagctggattggtgtctagagttgccaacgcattggcaaacacatctacactcagggctgtcctgagacgtggagtgtccccacaaacagcctcatccgttgttcaacgtgcagttcagtctttggcaggtacactgggtgtcgatggaaattcgctctctagaattgccctccaagccatctcccaactgccagctggttctgacacgtctgcatacgcccaggccttttccagtgctttggtaaatgccggagtgctctccgcctctaatattgataccttgggttcaagagttttaagtgctgtcttgaacggagtctcctcagctgcccaaggtataggcttgaacgtcgatacaggatccgttcaatctgacatcagttctagtagctcatttctatcatcttcatctagctcttcctcaatttcccaaacttctgcatcttcgacatcaggtgcgggttataccggtcccgcaggtccaagtggatacacaggaccatcgggtccgtcaggatatacgggacctgtgggaggtgcggcacagtttggctcagtatctggtcaaacgagcttcggtcagacaagcggattcaccgcctcaaccggtggacaggctgcctttggtgcgacctca

SEQ ID NO: 353 - DNA, 645 bp, Artificial Sequence
  Description of Artificial Sequence: Synthetic polynucleotide
ggttcttctgcaggacttgtttcccgagttgctaatgccctggctaacacatccactttaagggctgtgctgagaagaggagtctcgcaacaaacagcctcaagcgtcgtccaaagagccgttcagtccttggccggaactctgggtgttgatggtaactctcttagccgtatcgctttacaagctatctctcaattgccagcaggatccgatacctccgcttacgcccaggccttctcttcggctctggttaacgccggcgttttgaatgctagtaacattgatacgttgggtagcagagttttgagcgctgtactgaacggtgtaagcagtgccgcccagggaattggactcaacgtcgactcaggctcgattcagagcgacatttcatcatcctctagctttttgtcatcatcgagttcctcgtcctcaatttcccaaacatctgcatcaagtacatccggtgcaggatatactggacctgctggtccgtcaggctacacaggcccatctggtccatcaggttacacaggacccgtaggtggagccgctcagtttggatcggtgtcaggtcagacatcttttggtcaaacttctggatttaccgctagtactggcggacaagcggcctttggagctacgtca

SEQ ID NO: 354 - DNA, 609 bp, Artificial Sequence
  Description of Artificial Sequence: Synthetic polynucleotide
ggtggaggtgtcggaagcctcaccggtcagacttcttttggccagactagcggcttcacgagtactgcgggagcacaaggcggtttcggcccaacaaccggcgcccaaagtgcattgatttctaggattgcaaacgccttggcaaatacttcaacgttaaggtccgtactacgtaccggcgtctctcagcaaaccgcctcaagtgtggttcagcgaactattcaaactcttgcttccaatttgggtatagatggcaataatctatcaaggatagcactgcaagctatttcgcaagtaccagcaggttctgatacatcagcctatgctcaagcgttctcaactgctttagtcactggaggagtgttaaacgcaaacaacgtcgataccctaggtagtcaagttctaagtgctgtgctcaacggagtttcatcggccgctcaaggactgggaataaatgtggacaccggatctgtacagagtgacattagatcatcatcctcttctttgtccacatcttcttcctctgcatctttcagtcaaacttccggagccgcttctaccactggttttactggcgctggtggatacccaggaggagctggaccatta

SEQ ID NO: 355 - DNA, 609 bp, Artificial Sequence
  Description of Artificial Sequence: Synthetic polynucleotide
ggtggaggtgttggatctcttacaggacaaacgagtttcggtcaaacctctggcttcacaagtaccgctggagctcaaggaggattcggtccgactacaggtgctcagtccgcattgatcagtcgaatcgccaatgcattggccaatacctctaccttgagatctgtcttgagaactggtgtaagtcaacagacagcatctagtgttgttcagcgagctattcaaacgctagccagtaatttaggtatagatggcaataacttgagtaggattgccctgcaagcaatatcccaagtaccagcaggttctgacacctccgcttatgcacaggctttcagtacagctctggtgactggcggcgttttaaacgccaacaacgttgatactttgggatcacaagtgctgtccgccgtgttaaacggagtttcatcggcagcacagggtcttggtatcaacgtggacactggtagcgttcaatcagatatccgatcatcaagttccagtctgtctacatcttcctcgtcggctagtttctctcagacttcaggtgctgcttctaccacaggttttaccggtgctggtggttaccctggaggtgcaggtcctcta

SEQ ID NO: 356 - DNA, 609 bp, Artificial Sequence
  Description of Artificial Sequence: Synthetic polynucleotide
ggtggaggcgtaggatcattgaccggccaaacaagctttggtcaaacttctggtttcacatcaactgctggtgctcaaggtggcttcggaccaacgacaggagctcaaagcgccttgatctccagaatagctaacgcactggctaacacatctactcttagatccgtcttgcgcacaggagtaagccaacagacagcatcaagtgtagtacagagaacgatccaaacgttggcatcgaacttgggaattgacggcaacaacctctcaagaatcgcattacaggctatatcacaagttccagctggctctgatacctcagcttatgctcaagcatttagtaccgcattagtcacaggcggagttcttaatgcaaataacgtggataccttgggttcccaggtgttgtcagctgtcttgaatggtgtgagctctgccgctcagggacttggtattaatgttgacacaggatccgttcaatccgacattagatcttcttcgtctagtctgtccacatcatcgtcatctgcctctttctcccagacatctggtgcagcttcgacaaccggatttaccggagctggtggttaccctggaggcgctggtccacta

SEQ ID NO: 357 - DNA, 609 bp, Artificial Sequence
  Description of Artificial Sequence: Synthetic polynucleotide
ggtggtggagtaggaagcttgaccggtcaaacttcctttggtcagacgtccggattcactagcactgccggagcccaaggaggattcggcccaacgacaggagctcaatctgcacttatatcgagaattgctaacgcccttgccaatacttcaaccttgaggagtgtgctgagaacgggtgtttcccaacaaaccgcatcctcagtcgtgcaaagagctatccagactcttgcatccaatttgggattggatggcaacaacctctctagaatcgctcttcaagccatttcacaggtaccagcaggcttcgatgcttctgcttatgcacaagctttctcgacggcattagttacaggtggagtgctaaacgctaataatgtagatacactcggctctcaagttttatcggctgttttaaacggtgtctcatctgctgctcagggtttgggtattaacgttgatactggatcagtccaaagcgatataagatctagtagctcgagtttgtctaccagtagtagtagcgcatctttcagccagacttcaggtgctgcttctacaacaggttttaccggagctggtggttaccctggaggagcaggaccacta

SEQ ID NO: 358 - DNA, 609 bp, Artificial Sequence
  Description of Artificial Sequence: Synthetic polynucleotide
ggtggaggagttggttctcttacaggtcagacttcctttggacaaacttcaggttttaccagcaccgcaggagctcaaggtggttttggaccaaccacgggcgcacaatctgccctgatttcaagaattgctaacgcattggctaacacatccactctgagatccgtgctgagaaccggagtttctcaacaaacagcttcatccgttgtccaaaggactattcaaactctcgcatcaaacttgggaattgatggaaataatttgtcgcgtatagccttgcaagcaattagtcaagtgcctgccggttcagatactagtgcatacgctcaggccttttcaacggctttggtcacaggaggagtcttaaacgcaaacaatgtggatacactaggatctcaagttttgagtgccgttttatccggagtatcctcggccgcccaaggcttaggaatcaacgttgatactggcagtgtccagtccgacattagatccagctcatcaagtttaagcacatcaagctcttccgcctccttcagtcaaacttctggagccgcatcaactacgggattcactggtgccggaggatacccgggtggtgctggtccacta

SEQ ID NO: 359 - DNA, 609 bp, Artificial Sequence
  Description of Artificial Sequence: Synthetic polynucleotide
ggtggaggagtgggctccctaactggacacacatctttcggacagacctctggattcacctcaactgctggcgcccaaggaggatttggacctacaactggtgctcaatctgctttgatctcaagaattgctaatgccttggcaaatacttcaactctgagatctgtactgcgtaccggagtttcacaacagattgcctcatcggtagtccaaagaactattcaaactcttgcctctaacttaggtattgatggtaacaacttgtcgcgtatcgcactacaagcaatatcacaggttccagctggaagtgacaccagtgcttatgctcaggcttttagcacagccttagtgacgggcggtgttctaaacgctaacaatgttgacactttaggtagtcaagtgttgagtgctgttttgaacggcgtctcctcagcagcacaaggtttgggaattaacgtggacactggctcagtgcaatcagacataagaagttcatcatcctctttgagcacttcctcatcatcagcaagtttctcacaaacaagtggagctgcctctacaacaggatttacaggtgctggtggctacccgggtggagccggaccatta

SEQ ID NO: 360 - DNA, 609 bp, Artificial Sequence
  Description of Artificial Sequence: Synthetic polynucleotide
ggtggcggagtaggttctctaacaggccaaacatcgtttggccagacttctggttttacatcaacagccggtgcccaaggtggcttcggacctatcacaggcgcccaatctgccctgatatcccgtatcgcgaacgctttggctaataccagtacattacgatccgtgttgcgaacaggtgtttcccaacagactgcttcgtcagtagtgcaacgtacgatacagacacttgcatccaacctcggtattgacggaaataacctgagtagaatagctttgcaggccatcagtcaggtgccagcaggtagcgacacctccgcttacgcacaagcctttagcactgctttggttactggaggtgttcttaatgccaataatgtcgataccctgggttctcaagtactttccgcagtattgaatggagtatcttctgcggctcaaggtttgggtatcaacgtggatacgggatcagttcaaagcgatattcgaagctcctcttcttctctttccaccagttctagtagcgcttcgttttcacaaacatccggcgctgcatccactaccggtttcacaggtgctggaggttatccaggtggagcaggaccatta

SEQ ID NO: 361 - DNA, 609 bp, Artificial Sequence
  Description of Artificial Sequence: Synthetic polynucleotide
ggtggtggtgtcggttcgcttaccggccaaacaagttttggccaaacctctggatttacctccacagcgggtgctcagggaggattcggacctactactggtgcccaatcagctctgatttctagaatcgcaaacgcattggcaaacacatctactttaagatcggtattgcgaactggagtctctcaacaaacggccagctctgttgttcaaagaacgatccaaaccttggctagcaacttgggtatcgatggtaacaacctatcgagaattgctctgcaggccatttcccaagtgccagccggatctgatacttcagcttacgctcaagctttttctacggcacttgttactggaggtgttttgaacgctaacaacgtggacaccctaggatcccaggtcctgtcggcagttctaaacggtgtatcctccgctgcacagggattgggaataaatgttgatactggctcggtacagagtgatatcagaagcagttcgtctagcttaagtacttcttcctccagcgcaagctttagtcagacttctggtgctgcatctacgaccggtttcaccggagctggcggctacccaggaggtgccggtccatta

SEQ ID NO: 362 - DNA, 600 bp, Artificial Sequence
  Description of Artificial Sequence: Synthetic polynucleotide
ggtgcaggttacacgggaccatccggcccatcgactggtccatccggttacccaggtcctctaggtggtggagctccatttggacaaagtggcttcggaggtagtgatggtcctcaaggcggttttggtgccaccggtggtgctagcgctggtttaatctcacgagttgctaacgctttggccaacacttccacactaagaactgtacttagaactggagtgtctcaacagatagcaagtagtgttgtccagagagcagcacaatctcttgctagtactttaggcgttgacggcaataatctcgccagattcgcagttcaagcagtttccagattgcccgctggatctgatacttcagcatacgcacaggcattcagtagcgccctgtttaatgccggtgtgttgaatgccagtaacatcgacaccctaggtagtagagtcctgtccgctttactaaacggtgtaagctcagctgctcaaggtttgggcatcaacgtggattctggttctgttcaaagtgatatttcgtcatcttcaagtttcttgtctaccagcagctcctcggcttcttactctcaagctagtgccagttctacttca

SEQ ID NO: 363 - DNA, 600 bp, Artificial Sequence
  Description of Artificial Sequence: Synthetic polynucleotide
ggtgcaggttacaccggtccatcaggccctagtactggtccgtccggatatccaggtttgctgggtggaggagctccatttggacaatccggatttggtggaagtgacggtccccagggtggattcggtgctacaggaggagcctcagcaggtttgatttctagagtagcgaacgcattagccaatacctcaactctgagaacggttctaagaactggtgtttcccaacaaatagcttcaagcgtcgtgcaaagggccgcacaaagtcttgctagtaccttgggagtcgacggaaacaaccttgccagattcgctgttcaagctgtttccagactacctgccggttccgatacaagtgcctatgctcaagcttttagttctgcattatttaacgcaggagttttaaacgcctccaatattgataccctcggtagtagagtattaagtgcactgctaaacggtgtcagttccgccgcccaaggtttgggcatcaatgtggactctggatctgttcaatctgacatctcttcatcatcatcttttttgtctacatcttcctcatccgcttcttattctcaggctagcgcatcaagtacctca

SEQ ID NO: 364 - DNA, 600 bp, Artificial Sequence
  Description of Artificial Sequence: Synthetic polynucleotide
ggtgctggatacacgggcccttcaggtccctctacaggacctagcggttacccaggaccactgggaggtggagctccatttggccagtccggtttcggtggcagtgacggcccccaaggcggattcggagctacaggcggtgcttccgctggtctgatatcccgtgtcgcgaacgctctggcaaacactagtacgttgagaacagttttgcgtactggcgtttcccagcagattgcttccagtgttgtacaacgagcagcccaaagtttagcttccaccttaggagtggatggtaataacctagctcgctttgcggtacaagcagttagccgccttccagcaggttccgacacgtcagcttatgcacaggctttctcatcagccctatttaatgctggagttttgaacgctagtaacatagatacattgggatcgagagtattgagtgctttattgaacggagtatcttcggctgcccaaggtctgggtataaatgtagactccggatcagtacaatcggacatctcttcgtctagtagttttctttctacaagctcttcctccgcttcttattcccaggcttctgcgagttctacttca

SEQ ID NO: 365 - DNA, 600 bp, Artificial Sequence
  Description of Artificial Sequence: Synthetic polynucleotide
ggtgctggttatactggtccatctggaccttcgacgggtccttctggttaccctggaccactgggaggcggtgcccctttcggacaatccggattcggtggaagtgccggtccacagggtggttttggtgcaaccggtggtgcttctgctggtttaatatcgagagttgccaacgctctggccaacacaagtactttacgaaccgtcctgcgaactggcgtatcccaacagatagcctcttcagtcgtacaacgtgccgctcaatccttggcttcgaccttgggagtggacggtaacaatcttgctagatttgctgttcaagctgtcagtagacttcctgctggaagtgataccagtgcttatgcacaagcattcagtagtgctttgtttaacgctggagtcttgaatgcctcaaacattgatactcttggttcacgtgttctatctgctttattaaacggtgtgagctcagccgcacaaggattaggaataaacgttgattccggaagcgtgcagtcagacatttcctctagctcaagctttttgagtactagtagctcttcagccagttactcccaagcctcagcatcctcaacttca

SEQ ID NO: 366 - DNA, 600 bp, Artificial Sequence
  Description of Artificial Sequence: Synthetic polynucleotide
ggtgcgggttatactggcccgtcaggtcctagtactggaccatctggttatccaggtccattaggaggtggtgctccatttggacaatctggtttcggaggttcagctggaccacaaggaggctttggtgcaactggaggtgcatccgccggattgatttcaagggtagcaaatgctttggcgaacacctccactcttagaacggttctccgaacaggtgttagtcagcaaatcgctagttccgtggtccaaagagccgcccagagtttggcatcaactttgggagttgatggaaataatttggcgagatttgccgttcaagctgtgtctagactaccggcaggaagcgatacttctgcgtacgcccaagccttctcatccgctttgttcaacgctggagtgttgaatgctagtaacatcgataccctgggcagtagggtcttgtcagcactgctcaatggtgtgtcgagtgctgcccaaggattgggtatcaatgtcgacagtggttcagtccaatccgatatctcttcgtcatcttcatttctaagtacgagctcttcctcagcttcatactcccaagcttcagcttcttccacctca

SEQ ID NO: 367 - DNA, 600 bp, Artificial Sequence
  Description of Artificial Sequence: Synthetic polynucleotide
ggtactggttacactggacctagtggtccttcaactggaccatcaggatatccaggaccactgggtggtggtgctccctttggacaatctggatttggaggctcagctggacctcaaggcggtttcggtgctactggtggagctagcgctggtttgatttccagagttgccaacgcactggcaaatacatccacattgagaactgtactcaggaccggtgtcagccaacagatcgcttcttcagtcgttcaaagggctgcccaatcattggcaagcactctgggcgttgatggtaacaatttagctagattcgcagtccaagctgtgtccaggctgccagctggttcagatacctccgcatatgcgcaggcattcagtagcgctctgtttaatgcaggagtattgaatgcttcaaatattgatactctcggtagcagagtcttatccgcattactcaatggagtatcatccgccgcgcaaggtttaggaataaatgtcgattccggttctgttcagtccgacatctcatcttcatcatcgttcctcagtacttcctcctcttcagcgagttactcccaggccagcgcctcttctacgtca

SEQ ID NO: 368 - DNA, 600 bp, Artificial Sequence
  Description of Artificial Sequence: Synthetic polynucleotide
ggtgcaggatataccggaccttccggaccatcaacgggtcctagtggttatccaggacctctaggaggtggcgccccttttggtcagagtggttttggtggttcagcaggaccccagggaggattcggagctactggtggtgcatcagctggtttgattagcagagtagcaaacgccctagcaaatacatcgactctaagaacagttttgagaacaggtgtctctcaacaaattgcttcctccgtcgttcaacgtgcagctcagtcattggcatctactttaggtgtggatggaaataatttggctagattcgccgtccaagctgtgtctcggctaccagccggctcggacacttcagcttacgcccaggctttctcatccgcactgttcaatgctggagtactaaacgcttcgaacatagatacgctcggatctagagttctaagcgccttgctgaatggtgtcagctccgcagcccaaggacttggaataaacgttgactcaggaagcgttcagtcggacatcagtagtagctcatcattcctgtccacctctagctcgtccgctagctacagtcaagccagtgcctcctccacttca

SEQ ID NO: 369 - DNA, 600 bp, Artificial Sequence
  Description of Artificial Sequence: Synthetic polynucleotide
ggtgcgggttacaccggaccgtcaggtcctagtactggcccgtccggttacccaggaccattaggcggtggcgcaccttttggtcagtcaggttttggaggctctgatggtcctcaaggaggattcggcgccacaggtggagcctctgctggactaatctcccgtgtggccaacgctctagcgaacacatccactttgaggactgtgctaagaaccggagtatcccagcaaatcgcatctagcgttgtgcagagggccgcacaatcactagcatctactttgggtgtagatggaaataatctggctagattcgccgttcaggccgttagcagactcccagccggttcagatacttctgcttatgctcaagcgttctcatccgccttgttcaacgccggcgttctaaacgcctctaacattgataccttaggttcaagagtcctaagtgccttacttaacggagtttcttccgctgcccaaggacttggtatcaacgtcgattctggttcggttcaaagcgatatttcaagctcctcttccttcttgtcaacttccagctcatctgctagctacagccaagcttcggcaagcagtacatca

SEQ ID NO: 370 - DNA, 567 bp, Artificial Sequence
  Description of Artificial Sequence: Synthetic polynucleotide
ggtttcaccggagcaagctatcccggtccacaagtctcacagcctgcacctttcggcgtcggcccacaaccaggaggtgctctacctggttttggacaagtatctggagctcaaagtgcccttatttctagaatcgccaacgctttgggtaacaccgctactatgcgagctgtcttgcgcagcggagtgagtcaacaaattgtctcaaatgttgttcaaggagctgtgcaggcattatcatccagtctgggaattgatggtaataacttggcaaggattgcttctcagaccatactcagagtacctgctggttcggacactagcgcatacgctcaagcattttctactgccctgttcaattcgggtgttttgaacgctagtaatgtgaacacattgggctcccaggtggtatcgacgttgctgcgtggcatctcatcaacggcacaaggtcttggattaaacgtcgacgcaggttccgttcaatccgatataagttctagtagttcctttctgtctacttcctcgtcctccacctcatcttcacaaacaactgcagcaagtacgtca

SEQ ID NO: 371 - DNA, 567 bp, Artificial Sequence
  Description of Artificial Sequence: Synthetic polynucleotide
ggtttcactggagcttcatatccaggaccacaggtgtcacagcctgcacctttcggtgttggtccacaaccaggtggtgcgttaccaggttttggccaagtttctggtgcacaatctgcacttatttcgagaattgcaaatgctctcggaaataccgctaccatgagagcagtgctgagaagcggtgtctcacaacaaatagtctctaacgtagttcagggagctgtacaagctttgtcctcatcacttggaattgatggaaataacctggcacgaatcgcttcgcagactatattacgagtgccagccggaagtgatacttcagcttacgctcaggctttctctactgccttgttcaattcaggagtattgaacgcgtcgaatgttaatacccttggttcgcaagttgtttccacactgctacgaggtatttctaacactgcacagggtctaggactgaatgtagacgctggtagtgtacagagcgacatctcttcatcctcttcgtttctaagcacctcatcttcctctaccagctcaagtcaaacgacggccgcatcgacttca

SEQ ID NO: 372 - DNA, 531 bp, Artificial Sequence
  Description of Artificial Sequence: Synthetic polynucleotide
ggtgcctcggctgctgatatcgcaactgcaattgctgcaagtgttgccacctccttgcaatccaatggagtactaaccgcctccaacgtgagtcaattgtctaatcagctggcatcttatgtttcttccggtctgtcctctacggcaagttcattaggaattcaattaggtgcctcccttggagccggcttcggagctagcgctggtcttagcgcctctaccgacatcagcagttccgtagaggccacttccgcttctactctatcatcaagtgcaagtagtacttcagtcgtatcaagtattaacgctcaactcgtgcccgcgttggcacagacagccgttcttaacgccgctttttctaacatcaacactcagaacgcgatccgaattgcagaactgttaacacagcaagtcggaaggcagtacggattaagtggaagcgacgtcgcaacggcatcgtcccagattagatctgctctatactctgttcaacagggttcggcttcatctgcatacgtcagcgcgattgta

SEQ ID NO: 373 - DNA, 540 bp, Artificial Sequence
  Description of Artificial Sequence: Synthetic polynucleotide
ggtcctctaataacagcactcagctcacgcggagtagtgaatgcttctaattcatcacagattgcatcgtccttagctacagctattctgcagtttactgcaaacgtggcaccacaattcggtatcagcattcccaccagcgcagtgcagtccgatctatctactattagtcagtccttgacggctatttcttctcagacctcctcaagcgttgattcttcgacgtctgcattcggtggaatcagtggtccgagtggcccatctccatacggaccacaaccatccggtcctacttttggtccaggcccaagtctttctggccttactggcttcactgctaccttcgctagctctttcaagtcgacacttgcttcgtcaacccagtttcaattgatcgctcaatccaacttggacgtgcagacaagatctagcttgattagtaaagtattgataaacgctttgtcctcactaggtatctccgcctcggtagcctcttcgatagccgcatcttcttcccaatctttgctgagcgtttctgca

SEQ ID NO: 374 - DNA, 531 bp, Artificial Sequence
  Description of Artificial Sequence: Synthetic polynucleotide
ggtgcttccgcggccgatatagcaaccgcaattgcagcatctgtagctacttcattacagagtaacggtgtcttgacggcatcaaacgtatctcaattgtcgaaccaattagcaagttatgtgagtagtggtttgtcaagcactgcatccagtttgggtatccaactcggcgctagcttgggtgctggtttcggtgctagcgccggattatctgctagtaccgacatctcctcgtcagtggaagcaacttcggcttcgactctgtcaagttccgcatcttccacgtcagttgttagttcaattaacgctcagctagttccagctctcgctcagaccgccgtgctgaatgccgccttttctaacattaatacccagaacgctatcagaatagctgaacttctgactcaacaagtaggcagacagtacggattgagtggttccgacgttgctaccgcatcctctcaaattagaagtgctctctatagtgtacaacagggtagtgcttcttccgcttatgtctcagccattgta

SEQ ID NO: 375 - DNA, 540 bp, Artificial Sequence
  Description of Artificial Sequence: Synthetic polynucleotide
ggtccgttgataactgctttgtcgtcaagaggtgtcgttaacgcctctaactctagtcagattgcttcctctctggcaacagctattctgcaattcactgctaatgtggctccacagtttggaatctctattccaaccagtgctgttcagtctgatcttagtactattagtcaatccctaactgcaatatcttcccaaacctcgtcatctgtcgattcctctacatccgcattcggtggcatcagtggtccttccggtcctagcccatatggccctcaaccttctggtcccacattcggtcctggcccatcattatctggattgaccggattcaccgctacatttgcctcgtcgttcaagagcactttagcatctagtacacaatttcagttgatcgcccagagtaatttggacgttcaaacaagaagtagcctcatatctaaagttttaattaatgcactgagtagtctgggtatatctgccagcgttgctagctcgatagctgcaagttcctctcagtctctactcagcgttagtgca

SEQ ID NO: 376 - DNA, 513 bp, Artificial Sequence
  Description of Artificial Sequence: Synthetic polynucleotide
ggtcctggttacggttacgctgcttactatgctgctaattatggctatggtcctggagtaggcgccggttctggtgcgggagccggctcaggctctggagtcggagcaggttcaggatttggagcaggtgcaggatcaggtactggactaggtagaggagctggaactggtgctggagcgggatctggagctggttcgggtgccggtgccggaagcggttctggtgctggtgcgggaagtggcagtggagcaggtgccggaagaggtgctggactcggaggttttggctctggattaggagccggagcaggaacaggagccggagctggttccggaagtggagccggcagcggagctggtgcaggcgctggatccggatttggtgcaggtgctggaagaggagctggttctggtggaacaggttcctggttgagatccggcgtcggtactggttcttctgcttctgccggctctgcaggatcaggtgcaggagtaggatctggtgctggtcca

SEQ ID NO: 377 - DNA, 507 bp, Artificial Sequence
  Description of Artificial Sequence: Synthetic polynucleotide
ggtcctgcatacggatatgctgcctactacgctgccaactatggttacggaccgggtgtaggtgccggttccggtgccggagctggttccggtagcggtgcaggtgctggttcgggttcaggtgctggtgctggctcaggagctggattaggtagaggtgcgggaaccggagcaggtgccggttcaggtgctggatccggcgccggagctggttctggtagtggcgctggtgccggttcaggatcaggagccggagcaggtcgtggtgccggattaggtggtttaggctccggtttgggagctggtgcaggtacgggtgccggatcgggatctggatccggtgccggatccggagccggagctggtgctggaagcggttctggcgcaggagctggtagaggagccggatccggattaggagcaggtttgggctctggtgttggaactggatcaggtgctggagctggcgctggatcaggagctggtgttggttcaggcgctggagca

SEQ ID NO: 378 - DNA, 492 bp, Artificial Sequence
  Description of Artificial Sequence: Synthetic polynucleotide
ggtccaggctacggatacgctgcatactatgccgcaaattacggatatggtccaggagtcggtgctggtagcggagctggtgctggaagtggatctggtgccggagcaggtagtggaagcggagcaggtgcaggttctggagccggtctgggtagaggagctggtactggcgctggagctggttctggagccggatcgggtgctggagctggatctggcagtggagcaggagccggatccggatctggtgctggagccggtagaggagccggtctaggtggactaggagcaggtttaggagccggagctggatctggtgcaggtgccggatccggcgcaggagctggtgctggcagtggttctggtgccggagctggtagaggtgctggactaggtggtcttggcgctggtctaggttccggtgttggtacaggcgctggtgcaggagctggcgccggttcaggtgcaggagccggatctggagccggtgca

SEQ ID NO: 379 - DNA, 504 bp, Artificial Sequence
  Description of Artificial Sequence: Synthetic polynucleotide
ggtccaggttacggttatgcagcttattatgctgccaattatggttacggacctggtgttggtgcaggttcaggagccggtgccggatcaggtagtggctcgggtgctggagccggatctggttctggtgctgcagctggaagtggagccggattaggtagaggtgctggtacaggtgctggagcaggttcaggagctggttcaggtgccggatctggtgcgggtgctggatcaggtagtggagcaggagctggtcgaggtgccggtcttggtagactgggttcaggtttaggcgctggcagtggtaccggagctggagctggatcaggttctggtgctggttctggcgctggcgcaggagccggtagtggaagcggcgctggtgcgggtcttggtgctggactaggaggactgggcgccggcttggtttccggagtcggtacaggcgccggagccggagccggagctggcagcggagcaggtgcaggaagtggagccggtgca

SEQ ID NO: 380 - DNA, 504 bp, Artificial Sequence
  Description of Artificial Sequence: Synthetic polynucleotide
ggtaaggccattagttccggtgctgccagtgccgcagcttctgcttctgctgcatcagcggccgctacagctgtggctgctgcttcattcagtgcttcaaccaccacgaccgccacctcaacgtcagccgctgctactggtgccgctgctgctgccggaggagaggctgctgcagtttcgagcactgcctcgtcatcatttttacaggctttggtgtcctcaatccttgaaagaccagagtttttggttccactaagtcacgctacttccgcttcttccgcttacgccatcacctcaacaattgtcagggacgcagcatacgaaaccgaattcagtaaatgggcaactcagatgagcagtgcggctgcgaaagaggttgctgaggttggaagcggagctagcgcctatgactatgcatatgccatggctcgtggtttgactaaatgtctatcgagatacaacttgattaacagccaagaccctactccttctgctagaaaatta

SEQ ID NO: 381 - DNA, 570 bp, Artificial Sequence
  Description of Artificial Sequence: Synthetic polynucleotide
ggtggacaaggtggacaaggtggctacggaggtttgggttcgcaaggtgctggtcagggcggatatggagctggtcaaggtgcagccgccgcagctgcagctgctggtggcgcaggtggcgctggaagaggaggacttggtgctggtggtgctggtcaaggttacggcgctggtctaggaggacaaggaggtgcaggtcaagctgccgccgcagccgctgccggaggagctggtggcgctaggcagggaggtctgggagctggtggtgccggtcaaggatacggtgctggtttaggcggtcaaggcggtgctggacaaggaggagccgctgccgccgctgctgctgctggtggacaaggcggtcaaggaggttatggtggtctgggttctcaaggtgctggacaaggcggttacggtgccggacaaggtggtgccgcagctgctgctgctgctgccggtggccaaggaggtcaaggtggttatggtggattgggatcacagggtgctggtcagggtggctatggaggaaggcaaggtggagccggcgccgctgctgcggctgctgctgca

SEQ ID NO: 382 - DNA, 654 bp, Artificial Sequence
  Description of Artificial Sequence: Synthetic polynucleotide
ggtggctatggtcctggagccggtcaacaaggaccaggaggagcgggtcagcaaggccccggatcccaaggtccaggtggagctggacaacaaggacctggaggacaaggtccatatggtccaggagctgccgctgccgctgcagccgtcggtggctatggacctggagctggtcaacaaggtcctggttcccagggtcctggctctggaggtcaacaaggccctggaggtcaaggaccatacggaccgtcggcagcagcagccgcagcagccgctggtggatacggaccaggagcaggccaacaaggtccaggttctcaaggaccaggatcgggcggtcagcagggtccaggtggtttaggcccttacggacctagtgcagctgccgcagctgccgctgctggaggctacggccccggagcgggacaacagggtcctggatctcaaggaccaggttcaggaggtcaacagcgacctggtggattgggtccatacggtccttccgctgctgcagcagcagcagcggccggaggatatggccctggagccggacaacaaggtccaggatctcaaggccctggaagcggaggacaacaaagaccaggaggtttgggaccttatggtccatcagctgccgctgcagctgctgcagca

SEQ ID NO: 383 - DNA, 834 bp, Artificial Sequence
  Description of Artificial Sequence: Synthetic polynucleotide
ggtagtgcgccacaaggtgcaggtggtccagcgccacaaggtccttcccagcaaggaccagttagccagggtccatatggaccaggtgctgcagccgctgctgctgctgcaggtggttacggaccaggtgccggacaacaaggcccaggtagccagggaccaggtagtggaggacaacagggtccgggatcacagggaccaggatcaggtggccaacagggtcctggtggacaaggcccatatggtccatcggccgccgccgccgccgcagctgcagctggaggatacggaccaggagccggtcaacagggacctggttcccaaggtccaggttccggtggccaacagggacctggcggacaaggtccttacggtcctggcgcagctgctgctgccgcagctgttggtggttacggacctggtgctggacaacaaggccctggatctcaaggtccaggatccggaggtcaacaaggacctggaggacaaggaccttatggtcctagtgcggcagcagcagctgctgcagccggaggttatggaccaggtgctggtcaacaaggtccaggttcacaaggtcccggttctggtggacaacagggtccaggtggacagggtccatacggaccttcagctgccgcagctgccgctgccgcaggaggttacggtcccggagctggtcagcaaggtcctggatctggaggacagcaaggtccaggtggacaaggaccatacggctccggccagcagggaccaggtggtgcaggacaacagggcccaggcggacaaggaccttacggaccaggtgcagctgcagctgctgctgcagcagca

SEQ ID NO: 384 - DNA, 753 bp, Artificial Sequence
  Description of Artificial Sequence: Synthetic polynucleotide
ggtggttacggtcccggagctggacaacaaggacccggaggtgccggacagcaaggacctggttctcaaggacctggaggtcaaggaccatatggcccaggagccggacaacaaggtcctggtagccagggaccaggttcgggtggtcaacaaggtccgggaggtcaaggcccatacggtccatccgcagctgcagcagcagctgctgccggcggttatggtcctggtgccggccagcaaggaccaggttcacagggcccaggttctggaggtcaacaaggtcctggatctcaaggtcctggtagtggtggccaacaaggaccaggtggacaaggcccatatggcccttccgccgctgctgctgcagcagcggccggaggatatggtccaggagcaggtcagcagggtccaggttctcaaggaccaggctctggcggtcagcagggacctggtggtcaaggaccttatggaccaggagcagctgccgcagccgctgctgtcggaggttacggacctggagcaggtcaacagggtccaggatcgcagggaccaggatccggtggacagcaaggtccaggcggacaaggaccttacggaccatcagctgccgctgccgcggccgctgctggaggttatggaccaggcgcaggtcaacaaggacctggtagccaaggccctggtagtggtggacaacagggtccaggtggtcaaggtccatatggtccatccgcagcggctgctgctgctgccgca

SEQ ID NO: 385 - DNA, 684 bp, Artificial Sequence
  Description of Artificial Sequence: Synthetic polynucleotide
ggtggatatggacctggcgctggtcagcaaggtcctggatctggaggacagcagggacctggtggacaaggtccatatggcagcggtcaacaaggaccaggtggagcaggtcaacaaggacctggaggtcagggaccttatggccctggtgcagccgcagccgcggccgccgctgctggtggttacggaccaggcgcaggtcaacaaggtcctggcggtgctggacaacagggcccaggttcccagggcccgggtggtcaaggtccatatggtcctggagcaggacaacagggtcctggttctcagggtccaggtagtggcggtcaacaaggtccaggaggccaaggtccttacggcccatcagccgcagcggctgccgctgctgctgccggtggttacggacccggtgctggtcaacgaagtcaaggtccaggaggtcagggtccatacggtccaggtgcaggtcagcagggaccaggatctcaaggtccaggttcaggaggccaacaaggcccaggaggtcagggaccatatggtccatctgctgctgctgctgccgctgccgcaggacctggtgctggtagacaaggtcctggtagccaaggtcctggatccggaggtcagcaaggcccgggcggtcagggtccatatggaccatcggctgctgccgcagctgctgctgca

SEQ ID NO: 386 - DNA, 771 bp, Artificial Sequence
  Description of Artificial Sequence: Synthetic polynucleotide
ggtcctggagcaagaaggcaaggtccaggtagtcagggcccaggttcgggtggtcaacaaggaccaggtggtcagggtccatatggtagtggccagcaaggtccaggtggcgccggtcaacaaggtccaggcggacaaggaccttacggtccaggcgctgccgccgcagcggctgcagccgcaggtggctatggtcctggtgctggccaacaaggaccaggaggagctggccaacagggaccaggaagtcaaggacctggaggacagggaccatatggtccaggagcaggacaacaaggtccgggctcccagggtccgggatctggaggacaacagggccctggaggacaaggtccatatggaccttcggccgccgcagctgcagctgccgcaggaggatatggccctggtgctggacaacagggacctggatcccaaggacctggtagtggaggtcaacaaggcccaggaggacaaggtccttacggtcccggtgcagctgccgctgctgccgctgtaggcggttacggaccaggagcaggtcaacaaggtcctggttctcaaggacctggttcaggaggacaacagggtccaggcggtcaaggcccttatggaccatccgctgctgctgctgcagctgcggcaggtggctacggtcctggtgccggacaacaaggtccaggatctcagggacctggttccggaggacaacaaggaccgggaggacaaggtccgtatggtccttctgctgccgcagccgcggctgctgca

SEQ ID NO: 387 - DNA, 765 bp, Artificial Sequence
  Description of Artificial Sequence: Synthetic polynucleotide
ggtggatacggaccaggtgcaggacaacaaggccctggttccggtggacaacaaggaccaggtggacagggcccttacggctcaggtcagcaaggtccaggaggagcaggtcaacagggtcctggtggtcaaggaccttatggaccaggagctgctgccgcggcagcagcagctgccggaggttacggtccaggtgccggacaacagggtcctggaggtgctggacagcagggtccagagggaccaggttcccaaggtcctggatctggtggtcaacaaggaccaggaggtcagggcccttacggtccaggagctgcagccgctgctgctgcggtcggaggttacggacctggagctggacaacaaggacctggttcacagggacctggaagtggtggtcaacaaggtcctggaggccaaggcccatacggtccatcagctgccgctgccgcagctgctgccggtggttatggtcctggtgctggtcaacaaggtccaggatcgcaaggcccgggatcgggtggacaacagggtccgggaggtcagggaccatatggcccaagtgccgctgcagcagccgccgcagctggtggatatggaccaggagcaggtcaacaaggacctggatccggtggacaacagggaccaggtggacaaggaccatatggatctggtcaacagggaccaggaggtgctggccagcaaggccctggtggtcaaggaccatatggtccaggagcggccgctgctgcggccgctgctgca

SEQ ID NO: 388 - DNA, 756 bp, Artificial Sequence
  Description of Artificial Sequence: Synthetic polynucleotide
ggtggatacggtccgggtgcgggtcaacagggaccaggtggagctggtcaacagggacctggatcacaaggacctggaggtcaaggcccttatggtcccggtgcaggacaacaaggacctggatcgcaaggtcctggatctggaggacagcaaggtcctggtggccaaggcccatacggtccatcagccgcagctgccgcagctgctgccggaggttatggaccaggtgctggtcaacaaggcccgggttcacaaggacctggtagtggtggtcagcaaggaccaggtagtcagggaccaggatcaggtggacaacaaggtccgggtggtcaaggtccatatggaccgtccgctgcggctgcagcagctgctgccgcaggaggttacggacctggcgctggtcaacagggtccaggttcccaaggacctggttctggaggtcaacaaggtccaggtggacagggcccatacggaccaggagcagccgccgccgcagctgctgtgggtggttatggtccaggtgccggacagcaaggaccaggatcccaaggaccaggttctggcggccaacagggtccaggaggccagggcccttatggaccaagtgctgccgcagccgccgcagcagcgggtggttacggtccaggtgccggtcaacaaggaccaggatctcaaggtccaggttccggcggtcaacaaggcccaggaggtcagggtccttatggaccatcggcagctgctgctgctgcagcggca

SEQ ID NO: 389 - DNA, 783 bp, Artificial Sequence
  Description of Artificial Sequence: Synthetic polynucleotide
ggtggttacggtccgggcgctggacaacaaggaccaggttctggtggacaacaaggtcccggtggacaaggtccttacggttcaggccagcaaggtccgggaggagctggtcaacaaggaccaggcggtcaaggtccatacggaccgggagcagcagctgcagcagcagccgctgctggtggatatggtcccggagctggtcaacagggacctggaggagccggacaacaaggacctggtagtcaaggtcctggtggacaaggtccatacggcccaggagcaggtcagcaaggtccgggttctcaaggtcctggctcaggtggacaacaaggcccaggtggacaaggaccatatggtccttctgctgctgccgctgctgcagcagcaggaggatatggaccaggtgctggtcaacagggtccaggttctcagggcccgggttccggaggacagcaaggaccaggcggacaaggcccttacggaccgtcggccgccgctgcggctgctgcagcaggaggatacggtcctggcgcgggtcaacaaggtcctggatctggcggtcagcaaggtccaggaggtcaaggaccatacggttctggtcaacaaggcccaggaggagctggacagcagggccctggaggtcaaggtccttacggtggcggttatggtccaggtgctggacaacagggtcctggatcgcagggaccaggaagtggcggtcaacaaggtccaggtggtcaaggtccttatggtcctagcgccgctgcagctgcagctgcagca

SEQ ID NO: 390 - DNA, 774 bp, Artificial Sequence
  Description of Artificial Sequence: Synthetic polynucleotide
ggtccaggagcccgtagacaaggtccgggctcacaaggtccaggatctggtggacaacaaggaccaggtggccaaggcccatacggatctggacaacagggtcctggtggagctggtcaacagggtccgggcggtcagggcccctacggtccaggagcagcagctgctgcggctgctgcagcaggaggatatggacctggagccggtcaacagggacctggaggtgctggccagcagggtcctggttctcagggaccaggtggtcagggtccatacggcccaggcgccggtcagcaaggaccaggttcacaaggcccaggctctggaggtcagcaaggacccggaggtcaaggtccttatggtccaagtgccgctgctgctgctgctgcagctgcaggaggatacggtccgggagctggtcagcaaggacctggttcgcaaggtcctggtagtggtggccaacaaggtccaggtggtcaaggaccgtacggtccaggagctgcagctgccgccgctgctgtaggaggatacggtccaggtgctggtcaacaaggtcctggaagtcaaggtccaggatccggaggtcagcagggacctggtggacaaggaccttatggtccttctgcagcagctgcagcggctgccgctggtggatatggtcctggagctggacagcagggcccaggatctcagggcccgggttctggaggacaacaaggacctggtggacagggtccatacggaccttccgctgccgccgcggcagctgcagca

SEQ ID NO: 391 - DNA, 732 bp, Artificial Sequence
  Description of Artificial Sequence: Synthetic polynucleotide
ggtggtcagggaggaagaggaggattcggaggtctaggatcacagggcgagggaggagccggacagggaggtgcaggcgcagctgcagctgctgccgctgcaggagctgatggtggtttcggtctaggaggctacggagctggacgaggttatggagcaggactaggaggtgcaggtggagctggtgctgcttcagctgccgctgccgctggtggtcaaggtggaaggtctggtttcggtggcctgggttctcaaggagccggcggtgcgggtcaaggaggtgccggcgctgccgccgcagctgctgcagctggtgccgacggtggctctggtctgggaggatatggagctggacgtggttatggagctagcttgggtggagctgatggtgctggagctgcctccgcggcagccgccgctggaggacaaggtggcaggggtggttttggtggtttgggctctcaaggagcaggtggtgcgggacaaggtggtgccggtgctgctgccgccgctgctgctgcatctggagacggaggttctggattaggaggttatggtgccggaagaggatacggcgctggtcttggaggcgctggcggtgctggtgccgcttctgccgcagctgctgccggtggtgaaggaggacgtggaggttttggaggactcggatctcagggcgctggtggtgcaggacaaggtggctccctcgcggcggccgcagccgcagccgca

SEQ ID NO: 392 - DNA, 723 bp, Artificial Sequence
  Description of Artificial Sequence: Synthetic polynucleotide
ggtgctgatggcggttcaggacttggaggttacggtgccggtagaggttacggagcaggactaggtggagctgatggagccggtgccgcttctgctgcagccgccgcaggaggacaaggtggtagaggtggttttggtagactcggttcgcaaggagctggaggagcaggtcaaggtggagctggcgcagccgctgcggttgccgcggcgggaggtgacggaggttcaggtcttggcggttacggcgctggtagaggatacggcgctggtttaggtggtgctggcggagctggagccgcatccgctgcggccgccgctggaggccaaggcggccgaggaggtttcggtggactgggatcacaaggagctggtggagctggccagggaggtgctggcgcagccgcctcgggagatggaggtagcggactaggtggatacggagctggccgtggttacggagctggattgggaggcgctgatggtgctggtgccgcttcagctgcttcagcagccggtggccaaggaggtaggggtggttttggaggactcggaagtcaaggagcaggaggagccggtcaaggcggtgctggtgcggccgccgctgcagctactgccggtggtgatggaggctccggactaggaggttatggtgccggaagaggttacggtgcgggcctgggcggtgctggaggtgcaggtgctgcttcggccgcagccgccgca

SEQ ID NO: 393 - DNA, 840 bp, Artificial Sequence
  Description of Artificial Sequence: Synthetic polynucleotide
ggtggacagggcggaagaggaggttttggaggattgggatcccaaggtgctggaggagccggacagggtggcgctggagcagctgctgccgcagctgctgctggaggtgacggaggttccggtttaggcggttacggcgccggtcgaggacacggagtaggtcttggaggtgccggtggtgcgggtgccgcttccgctgctgcagctgccggtggtcaaggaggacgcggaggtttcggaggacttggatctcaaggtgctggtggtgccggtcaaggtggtgctggtgccgctgcagcggctgctgcagctggtggtgatggcggttcaggtttgggaggatacggtgcaggtagaggtcacggtgctggtttgggcggtgccggaggcgcaggtgctgcctctgcagcggcagcagctggaggtcaaggtggaagaggaggatttggtggcctgggttcgcaaggctccggtggagcaggtcagggaggatctggagctgctgctgcagccgctgctgcaggcggagacggtggttctggcttgggtggttatggagccggtcgtggttatggcgcaggtctgggtggtgctggcggagctggcgcagcttccgctgcggctgccgccggaggccagggtggaaggggaggattcggaggattaggatcgcaaggtgccggtggcgccggacaaggaggatcaggagctgctgctgccgctgccgcagccgtcgctgacggtggatctggtttgggaggatatggtgcaggcaggggatacggagctggattaggaggtgcaggaggtgctggtgcagcttcagcagccgctgccaca

SEQ ID NO: 394 - DNA, 693 bp, Artificial Sequence
  Description of Artificial Sequence: Synthetic polynucleotide
ggtggtcaaggcggacaaggaggatatgacggactaggtagccaaggtgcaggtcaaggaggttacggtcagggaggagccgctgcggcggctgcagctgcctctggtgcaggatccgctcaaagaggaggtttgggtgcaggtggtgccggacaaggttacggtgccggatccggcggtcaaggaggcgcaggtcaaggaggcgccgctgcagccactgctgctgccgctggtggacaaggcggtcaaggtggttacggtggattgggatctcaaggatcaggccaaggcggctacggccaaggaggtgctgctgctgctgcggctgccgcatcaggtgacggaggagctggtcaagaaggacttggtgctggtggagctggacaaggttatggcgccggtcttggtggacagggtggcgcaggacagggtggtgctgccgccgctgctgctgcagccgctggaggtcaaggcggtcagggcggatatggtggcttaggctctcaaggtgctggacaaggtggttatggacaaggtggtgcagctgcagctgctgctgcggcctctggagctggtggtgctggccaaggaggtctaggcgcagctggcgctggtcaaggttacggagcaggatctggcggacaaggtggtgccggtcaaggtggagctgctgcagcagctgccgcagcagca

SEQ ID NO: 395 - DNA, 693 bp, Artificial Sequence
  Description of Artificial Sequence: Synthetic polynucleotide
ggtggacaaggaggtcaaggaggttacggtggattgggttctcagggagctggtcaaggtggatacggacagggaggtgttgctgcagctgcggctgctgccagcggtgcaggaggagccggacgtggtggtctgggcgctggtggtgccggtcaagaatacggagcagtttctggtggacaaggaggtgcgggtcagggaggtgaggctgcagctgctgcagcagctgccggtggccagggaggacaaggtggctatggtggactcggtagtcaaggagcgggtcaaggcggatatggtcaaggtggtgctgccgcagctgccgctgcagcctccggtgccggaggtgctagacgtggtggattaggagctggaggtgcaggacaaggatatggtgccggattgggtggacaaggtggagccggtcaaggaagcgcttcagccgccgcagctgctgcagctggaggacagggaggtcaaggtggatatggcggacttggtagtcaaggcagtggtcaaggtggttatggacagggcggtgccgctgctgctgcagccgctgcatcgggtgctggaggtgccggccgaggatctttgggagccggaggcgccggacaaggttacggtgctggacttggtggtcaaggtggagcaggtcagggtggtgccgctgctgccgcttctgctgcagca

SEQ ID NO: 396 - DNA, 405 bp, Artificial Sequence
  Description of Artificial Sequence: Synthetic polynucleotide
ggtggttatggtcctggagccggacagcagggacagcaagcgggtcaaggttccggacagcagggcccaggtggtgcaggacaaggtggtccacgaggtcagggaccttatggacctggagcagctaccgctgcagcagcagctgcaggacctggttacggtcctggagctggacaacaaggtccgggttcgcaaggtcctggttcaggaggacagcaaggacctggttcacaaggtccttatggcccatctgctgctgccgctgctgccgcagcaggaccaggttacggacctggtgctggtcaacaaggtcctggtagtcagggccctagaagtggaggacaacaaggccctggtggacaaggaccttacggtccttccgccgctgctgctgccgccgcagca

SEQ ID NO: 397 - DNA, 420 bp, Artificial Sequence
  Description of Artificial Sequence: Synthetic polynucleotide
ggtccaggttatggaccaggagctggtcagcagggccctggttccggtggacaacaaggtggaccaggctctggccaacagggcccaggtggtgccggtcaaggaggacctagaggtcaaggtccatatggtccaggtgcagctgccgccgccgcagctgcagctggtggatatggaccaggtgctggccagcagggaccaggttctcagggacctggtagcggtggccaacagggaccaggaagtcagggcccatatggacctagtgctgctgcagctgctgctgccgcgggtccgggatatggcccaggagcaggacagcaaggccctggctctcaaggccctggttcaggtggacagcaaggtccaggaggacaaggaccttatggtccatctgcagctgctgccgctgcagcagca

SEQ ID NO: 398 - DNA, 420 bp, Artificial Sequence
  Description of Artificial Sequence: Synthetic polynucleotide
ggtccaggatatggaccaggtgcaggacagcagggaccgggatcaggaggacaacaaggcggtcaaggttcaggtcaacaaggtccaggaggtgctggccagggaggtcctagaggtcaaggaccatatggacctggtgccgctgcggctgccgcagctgcagcaggtggttacggtccaggtgccggacagcaaggcccaggatcacagggtccaggttctggtggtcagcagggtccgggttcgcaaggaccctatggtccatcagccgcagctgctgctgccgcagctggtccaggttacggacctggtgctggccaacaaggaccaggcagtcagggtccaggtagtggtggtcaacaaggcccaggtggtcaaggaccttacggtccatctgctgctgccgctgctgcggcagca

SEQ ID NO: 399 - DNA, 417 bp, Artificial Sequence
  Description of Artificial Sequence: Synthetic polynucleotide
ggtccaggatacggcccgggagccggacaacagggtcctggttcaggaggtcaacaaggcggccaaggttctggccaacaaggacctggtggtgctggacagggaggtccaaggggtcaaggaccatatggtccaggtgctgctgctgctgccgccgctgctggtggttatggccctggagctggacaacaaggaccgggttctcaaggaccaggctctggaggtcagcaaggcccaggttcccaaggcccgtacggtccatctgcagcagcagctgccgctgctgctggtcctggttatggtccaggagctggacagcaaggtcctggatctcagggtccaggatctggtggacagcagggaccaggaggtcaaggtccatatggaccatctgacgctgctgccgcagctgcagca

SEQ ID NO: 400 - DNA, 417 bp, Artificial Sequence
  Description of Artificial Sequence: Synthetic polynucleotide
ggtcctggttatggacccggtgccggacaacaaggaccgggttcaggtggccagcaaggaggtcaaggttcaggacaacaaggtcctggtggtgctggacagggaggacctagaggtcaaggaccctacggtccaggagcagcagctgcggccgctgctgctggaggatacggtccaggtgcaggacagcaaggacctggctcacagggaccaggcagtggaggacaacagggacctggctctcaaggtccgtatggtccaagtgctgccgcggcagcggctgctgccggtccaggttacggccctggtgcaggtcaacagggcccaggttcacaaggtcctggttctggtggacagcagggtccaggttctcaaggaccttatggtccatctgccgcagctgccgcagctgctgca

SEQ ID NO: 401 - DNA, 552 bp, Artificial Sequence
  Description of Artificial Sequence: Synthetic polynucleotide
ggtgcagcagccgcgtccgaggcagcagcctccgctgccgcaacatccacaaccacaacaacaagcacttccagagcggcggccgccgcctcggctgcagccgcagcttctgcatctggtgctgctggtgctgcaggagcagcctctgctgcatccgctgcttctgcaagctcctcgttgcagcaatcacttggttcagccctggcacaaagtagttcttttgctgccgcgtttgctcaagcatccagtgctgccagcgcagctgctattgcttatgccttagctcaaacggttgccaaccaaataggtttctccagttattcgtccgcatttgccagagccgcatcttccgccgtatattctattggaggtttggcttctgcgagcgcttatgcattcgcatttgcttctgcctttagtcaagtattgtctaactatggactcctcaatatcaacaatgcttatagcttggcttcatccattgcctcagctgcctcctcgtctgcttcaagcgccgctgccgctgctgccagctcgtctagtgccgctgca

SEQ ID NO: 402 - DNA, 549 bp, Artificial Sequence
  Description of Artificial Sequence: Synthetic polynucleotide
ggtgctgccgcagcttcgggaactgcagcttccgcagcagctacttcaacaactaccacaacatcaacttctagagccgcagcagcggcaagtgcggcagcagctgcttccgctagtggtgctgctgatgccgctggtgctgcatccgctgcaagcgctgcttcagcatcctcatctctccagcagtcccttggttctgctcttgcccaaagttcgtcatttgctgcagcattcgcacaagcgaattctgcagccagtgctgcagccatagcctacgctttggcacagacagttgccaatcaaattggcttttcatcatacagttctgcgttcgcgtctgccgcatctagcgctgtatctagtttgggcggattcgcttcagcttcagcttacgcttttgcatttgctagtgcattttcacaagttttgtcaaattatggcttactgaacattaataatgcctactcattggccagttccattgcatctgctgctagttcttcagcctcaagcgccgctgccgctgcttcttcatcttccgctgccgca

SEQ ID NO: 403 - DNA, 531 bp, Artificial Sequence
  Description of Artificial Sequence: Synthetic polynucleotide
ggtagtggtgctgcgagggccgctcagacagcctccgccgcttccgctgcatctgcttcgagttcacttcagcagtcacttggttccgcactcgctcaaagctcaagttttgcggctgcgtttgaccaggctaactcagccgcttcggctgctgcaatcgcttacgccctggctcaatctgctgcaaaccaagtaggactgagctcatattctgcagctatttctaatgctgcggcagctgctgtgggttccgtcggaggctacgcttctgcttcggcttatgcttttgcgtttgcatctggagtttcacaagtgttgagtaactacggattaattaatctatctaacgcattgtttttggccagtagtattgcaaatgcagcaagtgcaagtgcatcctctgccgcagccgcagctagttcttcgagcgcagctacgggcgccgctgctgcactgggtggtgccggtagtgctgcagcaacctccacgactactatcacttcgacctctacggcggtggcagcagcttca

SEQ ID NO: 404 - DNA, 708 bp, Artificial Sequence
  Description of Artificial Sequence: Synthetic polynucleotide
ggtcctggaggttacggtggaccaggacagcagggtcctggtcaaggacaacaacaaggacctgcttcagctgccgcggccgctgctgccgctggacctggaggatatggtggacctggtcagcaaggacctggacaaggtcaacagcagggtcctgcaagcgctgccgcagcggctgccgccgctgcgggtcctggtggatacggaggacctggacagcagcgtcccggacaggctcaatacggtagaggtaccggtcaacaaggtcaaggtccaggtgctcaacaaggtccagctagtgcagctgccgcagctgcagctggagctggattatacggcggaccaggtcaacaaggccctggtcaaggtcagcaacaaggacccgcatcagcagcagctgccgctgccgctgctgccgcagctggaccaggcggatatggtggtccgggtcaacagggtccaggacaagcccaacagcaaggaccagcctctgctgctgctgccgctgctgctggcccaggaggctactccggaccaggacagcaaggtcctggacaggctcaacaacagggtccagcttcagccgctgccgccgccgccgctgccgctggtccaggtggttacggtggtcctggccaacagggtccaggtcaaggccaacaacagggacctgcttccgctgctgctgctgcagccgctaccgcagca

SEQ ID NO: 405 - DNA, 684 bp, Artificial Sequence
  Description of Artificial Sequence: Synthetic polynucleotide
ggtccaggaggatacggtggtccaggtcaacagggacccggacagggtcaatatggtccaggtactggtcagcaaggacaaggaccgtctggacaacagggaccagcaggcgctgccgcagcagcagccgctgcggcaggtcctggaggttatggtggtccaggtcagcagggtccaggtcaaggacaatacggacctggtgctggacaacaaggccaaggtcctggtggccaacagggtccggcgggtgctgctgctgcagccgctgctgctgcaggacccggtggttatggaggtccaggtcaacaaggacctggccaaggacaacaacaaggtagggcaggagcagcggctgcggccgctgctggaccaggaggctacggaggtccaggacagcaaggtcctggtcaagcacagcaacaaggaccggcagcagccgctagtgctggacctggtggttacggtggtcctggtcaacaaggacccggtcaaggtcaacagaagggacctgcatcagctgcagctgcagctgctgccacagcagccggtccaggaggatatggcggtcctggtcaacagggtcctggtcaaggccagtacggccctggtaccggtcaacagggtcaaggtccaggtggtcaacaaggtcctgcatcagctgccgccgctgcagctgctgctgca

SEQ ID NO: 406 - DNA, 732 bp, Artificial Sequence
  Description of Artificial Sequence: Synthetic polynucleotide
ggtcctggtggatacggtggaccaggccagcctggaccgggacaaggtcaatatggccctggtccaggccagcagggaccaagacagggtggtcaacagggtccagctagtgccgctgccgctgccgcagccggtccaggcggctacggtggtcctggacaacagggaccacggcagggtcaacagcaaggtcctgcatccgcagctgctgccgctgctgccgcagctgcgggtcccagaggttacggtggaccgggtcagcaaggaccagtacaaggaggacaacaaggacctgcctctgccgcagctgccgcagctgctgctggtgttggaggatatggtggtccgggtcaacaaggaccaggacaaggccaatacggtcctggaactggtcaacaaggacagggaccatccggacagcagggtcctgctggtgccgccgctgcagcagctggtggtgctgctggtccaggtggttatggaggtccaggacaacaaggtccaggtcaaggacaatatggtccaggaacaggtcaacagggccaaggcccaagtggtcaacaaggtccggcaggagcagccgcggctgccgctgctgctgccggtccgggaggttatggtggcccgggacaacagggtccaggacagggacagtatggtcctggtgcaggtcagcagggtcaaggtcctggttctcagcaaggtccagcatcagcggctgcagcagcagca

SEQ ID NO: 407 - DNA, 900 bp, Artificial Sequence
  Description of Artificial Sequence: Synthetic polynucleotide
ggtcctggtggttacggaggtcctggtcaacaaggtccaggtcaaggtcagtacggacctggaacaggtcaacaaggtcagggacctggtggacagcaaggaccagttggtgccgctgctgcggccgctgctgcagtttctagcggcggatatggttcgcaaggcgccggacaaggtggacaacaaggatccggtcagggcggaccagccgctgccggacctggaggttacggaggacctggtcagcagggtcctgagcagggtcaatacggttccggtgcaggtcaacaaggacaaggtcctggtggacagcagggacctgcttctgccgccgccgccgccgcagctggcccgggtagatacggtggaccaggtcagcagggacctggacaaggtcagtatggtccaggtacgggacagcagggtcagggtccagcatccgctgctgctgctgccgcagcaggaccaggaggttatggaggtccgggtcagcaaggtcctggtcagggcagaggaacaggacagcagggtcaaggattaggaggccaacaaggtcccgattctgctgccgctgctgccgccgctgccggtccaggaggttatggtggaccaggtcaacagggtccaggacaaggacaatatggacctggtacgggacaacaaggacaaggacctggcggtcaacaaggacccgtcggagctgccgcagctgctgcagctgcagtctcctctggaggatatggatcgcaaggcgctggacaaggaggacaacagggaagcggtcagagaggaccagcagctgctggtccgggaggttactcaggccctggacaacaaggccctggtcaaggtggacagcaaggtcctgcaagtgctgcagctgcagctgccgctgcagca

SEQ ID NO: 408 - DNA, 726 bp, Artificial Sequence
  Description of Artificial Sequence: Synthetic polynucleotide
ggtccaggaggttatgtaggtagtggtcagcaaggtcctggacagggaagaggtaccggacaacagggtcaaggaactggtggtcaacaaggtcctgctagtgccgctgcttccgcagctgctggaccgggcggatatggaggccctggtcaacaaggacctggacaaggaggccagcagggtccagccacagcggccgctgccgctgctgcggcagctggtcctggaggatatggaggtcctggtcaacagggtccaggtcaaggacaatatggaccaggtacaggtcaacaaggacagggtccaggcggtcaacagggaccagcaggcgccgctgctactgccgcagctgccgcaggacctggcggctatggaggacctggccagcagggcccagaacaaggtcaatatagaccaggagctggccagcagggacagggcccaggaggacaacagggcccagctagtgccgccgctgcagctgctgctggtccgggaggctatggtggtccaggtcaacaaggtccaggacgtggtcaatacggtccaggtactggacaacaaggtcagggtccggcctcggctgctgcagctgctgcagccggtcctggtggctatggaggtcctggacagcagggaccaggtcaaggaagaggaacaggtcaacagggacagggtttgggaggtcaacaaggaccagattctgcagctgcagctgccgcagca

SEQ ID NO: 409 - DNA, 687 bp, Artificial Sequence
  Description of Artificial Sequence: Synthetic polynucleotide
ggtccaggaggatacggaggaccaggtcaacaaggtccgggtcaaggccagtatggaccaggaactggacaacaaggacaaggaccaggtggacagcagggaccagttggagctgctgcggctgcagctgcggctgtgtctagtggtggttatggttcccagggtgctggtcagggtggccaacaaggctctggacagagaggtccagctgccgctggaccaggcggttattccggtccgggtcaacagggccccggacaaggtggccaacaaggaccagcatccgccgctgctgcagctgctgccgctgcaggtcctggtggatatggtggttccggccagcagggtcctggacaaggacgaggaactggtcaacagggtcaaggtccaggcggtcaacaaggtcctgcttcggcggccgccgcagctgccgccggacctggaggatatggaggtcccggtcaacaaggcccaggtcaaggtcaatatggacctggtactggacagcagggccaaggtcccgcttctgctgctgctgcagccgccgctggacctggtggatatggcggaccaggtcagcaaggtcctggtcagggtcaatacggtccaggtactggacagcaaggccaaggtccaggtggtcagcaaggaccgggaggagcaagtgctgctgcagctgcagcagca

SEQ ID NO: 410 - DNA, 468 bp, Artificial Sequence
  Description of Artificial Sequence: Synthetic polynucleotide
ggtacaggaggagttggtggattgttcctatccagcggtgactttggacgaggtggtgctggagctggcgctggtgcggccgccgctagcgcagctgccgcatctagcgcagctgctggtgctagaggaggttccggattcggtgttggtacaggcggttttggacgtggcggagccggagcgggtactggtgctgctgctgccagtgcagccgccgcctctgctgcggctgcaggagctggtggagatggtggcctattcctgagtagtggagattttggacgtggaggagcgggcgctggcgctggagctgccgcagcctctgctgctgccgcatcatctgccgccgcaggagcacgtggtggatcaggattcggagttggaacgggcggatttggcagaggtggagcaggagatggagcttcagcagcggcggcatcggcagcagcagcttcagctgctgctgca

SEQ ID NO: 411 - DNA, 702 bp, Artificial Sequence
  Description of Artificial Sequence: Synthetic polynucleotide
ggtgctggaggtgatggcggtttattcctgagctctggtgacttcggtcgaggtggcgcaggagccggagctggtgccgctgctgctagcgcagcagccgcttcttccgctgctgctggagccaggggaggatctggcttcggagtcggtaccggaggctttggtcgtggaggagccggtgatggagcttccgccgctgcagcttccgcagccgccgcctccgccgcagcagctggagcaggaggtgattccggactatttttatctagtggcgattttggtagaggaggagcaggtgctggtgcaggtgctgcagccgcgtcggccgctgcagcatcggcggccgccgccggtactggcggagtcggtggattattcctttcaagtggagattttggaagaggtggtgcaggagctggtgctggtgctgctgcagcttcagccgctgcagcatcttcggctgccgccggagcgcgtggaggttctggattcggcgttggtaccggaggattcggtcgtggaggaccaggtgctggtactggagccgcggctgccagtgctgccgctgcttcagcagctgcggcaggcgccggaggagattctggacttttcttatcttccgaggatttcggaagaggaggagctggtgccggtacaggtgccgcagcggcatccgcagcagctgcctctgctgccgctgca

SEQ ID NO: 412 - DNA, 729 bp, Artificial Sequence
  Description of Artificial Sequence: Synthetic polynucleotide
ggttcaggtgctggtcaaggtaccggtgctggtgctggtgctgctgctgcagcagccggtgccgcaggtagtggagctggtcaaggtgctggatctggagcaggcgcggctgcagcggcggccgcggcttccgctgcaggtgcgggccaaggtgctggatcaggtagcggagctggtgcggctgcggctgctgcggccgccgctggtgctggccaaggagctggaagcggatccggagccggcgcggctgccgctgctgccgcagcagccgcagcagctcaacaacaacaacaacagcaagcagcagctgctgcagcagctgccgctgcagccgcagctggttctggtcaaggtgcctctttcggagtaacgcaacaattcggtgcaccatctggtgctgcctcctctgctgctgccgctgctgctgcagcggctgccgccgctgctggcagtggtgcaggccaagaagctggcacaggtgctggtgcagccgcggctgctgcagccgcaggagcagccggatcgggtgcaggtcaaggcgctggaagtggagccggtgctgctgctgctgcggctgcagctgcctcagctgctggcgcgggacaaggtgctggttctggttcaggagctggtgctgccgcagctgctgctgctgccgccgctgcggcacaacagcagcagcagcagcaagcggcagcagctgcagctgctgccgctgcagctgccgca

SEQ ID NO: 413 - DNA, 567 bp, Artificial Sequence
  Description of Artificial Sequence: Synthetic polynucleotide
ggtggtgctggacaatctggctcaggtccatacggtgcttcttacttgtcctctacaacctatactacttcctctcaaggagcaggaggtggcgtcggtggttacggtcaaggttcaggaactggttccgctgcagctgctgctggtgctgctggcgctggccaaggaggccaaggaggttatggacaaggtgctggacagggtggtttgggtggatacggacagggtggtggagctggtgcagcagccgcagccgcggctgcagcaggaggtgcaggttccggtcaaggaggatatggaggccaaggaggcttaggtggttacggacagggtgctggtgctggtgctgctgccgcagccgctgccggaggtgcgggagcaggtcaaggtggatttggtggacaaggtggatatggacaaggtggcggcgctggagcagcagctgccgctgcagctgcagccgctgcaggcggagcaggatccggtcaaggtggttatggcggacaaggtggtcttggaggctatggacaaggagctggtgctggagctgctgctgcagcagctgca

SEQ ID NO: 414 - DNA, 498 bp, Artificial Sequence
  Description of Artificial Sequence: Synthetic polynucleotide
ggtggtgcgggagctggtcagggctcctatggaggacaaggtggttacggacaaggaggagccggtgccgccacagctaccgctgctgcagctggtggtgccggatccggacagggaggttatggaggtcaaggaggactgggtggctatggacaaggtgccggtgctggtgctgctgcagccgcagcagctgctgctggaggagccggcgctggtcaaggtggttacggtggtcaaggtggccagggaggatacggtcagggagccggtgcaggtgcagctgcagcagccgctggcggcgctggtgcaggtcaaggaggctacggcggacagggaggatatggtcagggtggtggtgctggagctgctgcagctgctgctgctgcatctggaggatcaggatccggtcaaggaggttacggaggtcaaggtggattgggcggttacggtcagggtgctggagccggagctggagccgctgcatcagcggcagccgca

SEQ ID NO: 415 - DNA, 456 bp, Artificial Sequence
  Description of Artificial Sequence: Synthetic polynucleotide
ggtgccggatctggtcaaggtggttacggtggccagggaggactgggaggttatggacaaggtgccggtgccggcgctgcagcaggagcctcaggctcaggctctggtggcgctggtcaaggaggtttaggcggttacggccaaggtgctggtgcaggtgcggctgcagcggctgcaggagctagcggagccggccaaggaggattcggaccatatggttcctcttatcaaagtagtacatcttactcagttacttctcagggagctgctggtggactcggtggatatggtcagggttccggcgctggagccgcagctgccggtgcggcaggacaaggtggtcaaggaggatatggccaaggtgcaggagcgggtgctggagcaggtgctggacaaggtggcctgggtggatacggtcaaggtgccggttcatctgctgcatctgctgccgctgca

SEQ ID NO: 416 - DNA, 684 bp, Artificial Sequence
  Description of Artificial Sequence: Synthetic polynucleotide
ggtcaaggtggtcagggaggatatggtggtttaggtcagggaggttatggtcagggtgctggttcgtctgcagctgcagcagctgccgccgccgccgcagctgccgctgcaggtaggggtcaaggtggttacggtcaaggatccggaggaaatgctgctgcggccgccgcagctgcagcagcagcagcatctggccaaggtggacaaggtggtcaaggaggacaaggtcaaggcggttatggccaaggtgcaggatcatcagctgcagcggctgccgctgctgctgctgcggctgccgctgcgggtcagggtcaaggtcgttacggtcaaggagctggtggcaacgccgcagctgctgcagctgcagcggccgccgctgctgccggtcaaggaggccaaggaggtcaaggtggtctgggccaaggtggatatggtcagggagcgggatcttcagccgctgctgccgcagcatcagctgcagcagccgccgctggtagaggtcagggcggatatggtcaaggcgctggcggtaacgcagctgccgcagctgctgccgccgctgccgcagctgccgccggtcagggtggtcaaggaggttatggtggtctaggtcaaggcggatacggacaaggtgctggatcatcagcagctgccgctgctgcagctgctgctgccgctgctgca

SEQ ID NO: 417 - DNA, 561 bp, Artificial Sequence
  Description of Artificial Sequence: Synthetic polynucleotide
ggtggacagggtggtcagggacaaggtagatatggacagggtgccggatcctcggccgcagcagctgccgcagctgctgccgctgctgcagctgccggtcaaggacaaggtggttatggtcaaggtgctggtggtaatgcagccgcagctgctgctgccgcagctgcagccgccgctggtcaaggtggacagggcggacaaggtggattgggccaaggtggatacggtcaaggtgcaggctcgtctgcagcggcagctgccgctgctgctgcagctgctgcagctggacgtggacagggtggctacggacagggtgccggcggaaatgctgccgctgccgcagccgccgcagctgaggctgctgctgccggacaaggaggccaaggaggatatggaggattgggtcagggtggttacggacaaggtgctggtagttccgcagcagcagctgcagctgccgctgcagcagctgctgctggacgtggtcagggtggttatggacaaggtgcgggtggtaacgccgcagctgcagctgcagccgcggcagcagcagcagccgca

SEQ ID NO: 418 - DNA, 585 bp, Artificial Sequence
  Description of Artificial Sequence: Synthetic polynucleotide
ggtcaaggtggccaaggtggctacggtggcttgggtcaaggtggttacggacaaggagctggatcatcagccgctgctgctgcagctgctgctgctgcagcagccgccggcggccagggaggtcagggacagggacgttatggccaaggagccggttcatctgcagcagctgcagcggcagctgctgctgcggccgctgctgctggaagaggacaaggtggttatggtcaaggttctggcggaaatgctgctgctgccgctgcagctgctgccgctgctgcctctggtcaaggatcacaaggcggtcaaggtggacagggtcaaggcggatacggacaaggcgcgggttcttcagcagccgctgctgcggccgccgctgccgctgctgctgcctcaggaagaggtcagggtggatacggacagggagcaggaggtaatgcagccgcagccgcggccgctgctgcagcggctgcagcagctggtcaaggtggtcaaggcggatatggtggtttgggtcaaggcggttacggacagggtgctggtagttctgctgcagcagcagccgctgcagctgccgccgcagca

SEQ ID NO: 419 - DNA, 561 bp, Artificial Sequence
  Description of Artificial Sequence: Synthetic polynucleotide
ggtggacaaggtggccagggtcaaggtggttacggacagggtgctggtagttctgctgccgccgccgcagcagcagcggccgctgcagctgctgctggtagaggtcaaggaggttacggacaaggatctggaggaaacgcagcagctgctgcagctgccgctgccgccgctgcaagtggccagggaggacagggaggccaaggaggacagggacagggtggatacggtcaaggcgctggatcttcggctgctgctgcagctgcagctgctgcagccgcggcagccgctggacaaggtcaaggcggatacggacaaggtgcaggtggaaatgcagctgctgctgccgccgcagcagctgccgcagctgctggtcaaggtggacaaggtggacagggtggcttgggacaaggaggatatggtcaaggagctggtagctctgccgcagcggcagcagccgctgccgcagcagctgcagctgcaggaagaggacagggaggttatggtcaaggtgttggaggtaacgctgctgctgccgcagccgctgctgccgcggctgccgca

SEQ ID NO: 420 - DNA, 675 bp, Artificial Sequence
  Description of Artificial Sequence: Synthetic polynucleotide
ggtcaaggtggtcagggtggacagggcggattgggccaaggaggttacggacaaggagcaggatcttccgcggctgcggcagctgcggccgccgctgccgccgcagctgctggcagaggtcaaggtggttatggtcagggatcaggtggaaacgcagccgctgcagcagctgccgctgctgctgccgcatctggacaaggttctcaaggaggacagggaggtcaaggtcagggaggatacggtcaaggtgctggttcctctgccgccgcagcagctgcggctgccgccgcggcagctgcttctggtagaggtcaaggaggttatggtcaaggagctggaggtaacgcagccgccgccgccgccgctgccgcagcagctgctgctgccggtcaaggtggtcaaggaggctatggtggcttgggtcagggaggttatggccagggcgcaggtagttctgctgcggccgctgccgcagccgcagcagcagctgctggaggtcagggcggacaaggccaaggaggttatggacaaggttctggaggttctgcagcagcagctgcagccgcagcagctgccgcagctgctgctgcaggaagaggacaaggtggatatggacaaggatctggtggaaatgcagcagcagcggctgctgctgccgctgcagcagccgctgca

SEQ ID NO: 421 - DNA, 657 bp, Artificial Sequence
  Description of Artificial Sequence: Synthetic polynucleotide
ggtggacagggtggattttcaggacaaggacaaggaggatttggtcccggcgctggttctagcgctgctgcagcagccgcagcagccgctgctgcaagacaaggaggacaaggacagggcggatttggtcaaggagctggaggtaacgcagctgctgctgcagccgccgctgctgctgcagctgccgcccaacagggaggacagggtggcttttcaggtagaggtcaaggaggtttcggccctggtgctggatcgtccgctgcggctgctgcagctggacaaggtggacaaggccagggaggattcggtcaaggtgcaggtggtaacgcagctgccgccgccgccgctgcagccgctgccgccgctgcagctggtcagggaggtcaaggtagaggcggttttggtcaaggagccggtggtaatgccgcggcagcggccgcagccgccgctgccgctgctgccgccgctcaacagggtggtcaaggaggttttggaggacgaggccaaggaggattcggccctggagcaggttctagtgcggcagcagctgcagcaggacagggaggacaaggaagaggcggttttggacaaggtgcaggaggtaatgctgctgccgcttcagctgcagctgctgcttccgccgccgcagcaggtcaa

SEQ ID NO: 422 - DNA, 576 bp, Artificial Sequence
  Description of Artificial Sequence: Synthetic polynucleotide
ggtggtcaaggaagaggtggttttggacaaggcgctggaggaaacgctgccgcagcagctgctgctgcagcagccgctgcggcagctcagcaggtaggccaattcggcttcggaggtagaggacaaggaggatttggacccttcgctggatcctcggcagccgctgctgctgctgcatccgctgctgcaggtcagggcggccagggtcaaggaggattcggccaaggtgccggtggtaatgcagctgcagctgctgcagcggctgcagcagcggctagacaaggaggtcaaggacagggaggattttctcaaggtgctggtggaaacgctgccgccgccgctgccgctgccgccgctgcagctgctgctgctcaacaaggtggccaaggaggatttggtggacgtggtcaaggtggttttggtccgggcgctggttcaagcgccgctgctgccgctgctgccactgctgctgctggtcagggaggtcagggtcgaggtggtttcggacaaggtgcaggttcaaacgccgccgctgcagcagctgcagctgcagcagcagcagctgctgcaggacaa

SEQ ID NO: 423 - DNA, 489 bp, Artificial Sequence
  Description of Artificial Sequence: Synthetic polynucleotide
ggtcagggaggacaaggaggttacggaggtttaggccaaggaggttatggtcaaggagctggatcttctgctgccgcagctgccgctgccgcagctgcagcaggtagaggtcaaggtggttacggtcagggttccggaggaaatgccgctgcagcagccgcagcagctgctgcggcagcatccggtcagggaggtcaaggtggacaaggcggacagggccagggtggctacggacagggagccggatcatcagctgcagctgctgctgcagcagcagccgctgccgctgcagcggccggtagaggccagggtggttatggtcaaggtgctggaggaaacgctgccgcagccgctgctgctgctgccgctgctgcttcaggtcagggtggacaaggtggccagggaggacagggtcagggaggttacggtcagggcgccggctcctcagccgctgctgcggctgctgcagcagctgcagccgctgctgca

SEQ ID NO: 424 - DNA, 537 bp, Artificial Sequence
  Description of Artificial Sequence: Synthetic polynucleotide
ggtcgtggtcaaggaggttatggtcagggttccggtggtaacgctgccgcggcagctgcagctggtcagggaggctttggtggtcaagagggaaatggtcaaggcgcgggaagtgcagcagcagctgccgcggcagccgctgctgcagctggtggctctggacaaggacgttacggaggtagaggtcagggcggttatggacaaggtgcgggagccgctgcctctgctgcagctgccgctgcagccgctgccgccggacaaggaggatttggtggtcaagaaggaaacggtcaaggtgcaggttcagctgctgccgcagctgcagctgctgctgccgccgcaggtggtagcggtcagggtggatatggtggtcgtggtcaaggtggatacggtcaaggcgctggagctgccgcagcagcagctgcagccgcagctgctgcagcagctggtcagggtggacagggtggtttcggatcgcaaggtggtaatggccaaggagctggttcagctgcagcggctgctgcagccgctgctgca

SEQ ID NO: 425 - DNA, 642 bp, Artificial Sequence
  Description of Artificial Sequence: Synthetic polynucleotide
ggtggttacagacctgtttcaggacaacaaggcccaggtcagcaaggaccaggatcaggtggacaacaaggtcctggaggacaaagaccctacggaccaggtgctgctgctgcagctgccgctgcaggaggatatggtccgggaagtggacagggtggtccaggccagcagggcccaggctccggcggtcagcaaggtcctggtggccaaggaccatacggtcctggtgctgctgcggcagcagctgcagcagctggtggatatggtcccggttctggtcagggtggacaacaaggaccaggatcgcagggtccaggttctggcggtcagcaaggcccaggtggtcaaggcccatatggaccgtccgctgccgcggctgctgcagctgttggtggttacggtccaggcgctggtcaacagggtccaggtcaacaaggacctggatctggaggtcagagaggcccgggaggacaaggtccatatggaccaggcgctgctgcggccgctgccgcagctgcgggtggttatggtcctgcatcaggccaacagggccctggtcaacaaggtcctggttccggaggacaaagaggccctggtggtcaaggtccttatggaccaggtgccgccgccgctgcttccgca

SEQ ID NO: 426 - DNA, 540 bp, Artificial Sequence
  Description of Artificial Sequence: Synthetic polynucleotide
ggtgcatcaggagccggtcaaggtcaaggttatggacagcaaggtcagggaggaagtagtgctgcagccgccgctgctgctgccgccgctgcagctgcggccgctcagggacaaggccagggttatggtcagcagggtcaaggttctgctgctgcagccgctgctgctgctgcggcgggtgcctctggcgctggtcaaggtcaaggatacggtcaacagggacaaggaagtgccgcagctgcagcagccgctgccgctgccggtgcaagtggagcaggtcaaggtcagggttacggacaacaaggtcaaggtggctcctctgctgctgctgcagcagctgctgctgccgctgcagccgctgcagcagcccaaggccaaggatatggtcaacaaggacaaggatcagctgcagccgccgcagctgcagctgctggagcatctggagctggacaaggtcaaggctacggccaacagggtcaaggcggctcttctgccgctgccgcagctgctgccgcggctgccgccgccgccgccgctgca

SEQ ID NO: 427 - DNA, 450 bp, Artificial Sequence
  Description of Artificial Sequence: Synthetic polynucleotide
ggtgcttccggcgctggacaaggacagggttacggacaacaaggccaaggaggcagttctgctgctgcagctgctgcggctgccgctgcggcccaaggtcaaggacagggatacggtcagcagggtcagggctatggacagcaaggtcaaggcggttcgtctgccgcagctgcagctgccgctgctgccgctgctgcagcacagggtcagggccaaggttacggtcaacaaggacaaggatctgccgccgccgctgctgcagctgcagctggtgcttccggtgccggccaaggacaaggttacggtcagcaaggacaaggtggatccagtgctgccgctgccgctgctgctgctgctgcagcagcagccgccgcacagggtcaaggatatggacaacaaggacaaggttcagcggctgctgcagctgcggcagctgctgcagcagccgca

SEQ ID NO: 428 - DNA, 546 bp, Artificial Sequence
  Description of Artificial Sequence: Synthetic polynucleotide
ggtgaggccttttctgcatcatccgctagttctgcagttgtgtttgaatctgcaggacctggtgaggaagccggtagttccggtgatggagcttctgctgctgcttcggccgctgctgccgcaggagcaggatcaggtagacgcggaccaggtggagctagatctagaggtggtgcaggtgctggcgccggtgcaggaagtggcgttggcggttacggatctggttctggcgcaggtgctggtgccggagctggcgctggagctggcggagaaggtggattcggagaaggtcaaggatatggagcgggtgccggagctggattcggatctggagcaggcgccggtgctggagccggttctggtgcaggtgcaggagaaggcgttggttctggagcaggtgctggtgctggagctggctttggagtaggtgcgggtgctggagcaggagctggtgctggattcggtagtggtgcaggtgccggttctggcgcgggtgctggatatggtgctggtagagccggaggcagaggtcgtggtggaagggga

SEQ ID NO: 429 - DNA, 546 bp, Artificial Sequence
  Description of Artificial Sequence: Synthetic polynucleotide
ggtgaagctttctccgcttcatcggctagttcggctgttgtattcgaaagcgctggacctggtgaagaggccggttcttcaggtggaggagcttcagcggccgcatctgctgctgctgctgcaggagctggatctggtagaagaggtccgggtggagccagaagcagaggaggagctggtgctggtgcaggcgcgggatctggtgttggaggatatggatcgggcagcggagccggagctggcgctggtgccggtgccggtgccggaggtgaaggcggctttggtgagggtcaaggttacggcgctggtgcaggtgctggctttggttccggagctggagcgggagccggagcaggttccggtgcaggagctggagaaggagtaggtagcggtgcaggagcaggtgcgggtgctggctttggagtaggagccggtgccggagctggagcaggagctggttttggctcaggcgctggagctggatctggcgctggagcaggatacggtgctggccgtgctggaggaagaggacgtggaggcagagga

SEQ ID NO: 430 - DNA, 549 bp, Artificial Sequence
  Description of Artificial Sequence: Synthetic polynucleotide
ggtagttacgcatacgcgcaggctgctgcaggtgctttcgcaaacgtcttgttccaagccggagttttaacctacgcaaatgcttctgcccttgctagcgcatatgcatcagcgtatgcctcttccgtcgcatcggcagctgcgtcagcttcggcaggagcatccgcttctagcggcgcttcggcatcagcttctgctgcagccgcagctgctgcagcggccgcagctagtgcctctgccggagcctcagcatcagcaggcgcgagtgcttcagcaggtgcttcagcgagtgcctcagcatcggccacagcatccgctttcgctagtgccttcgcatctgccgtagttcaaactggatacttttctaacgtgtttggtaatgtatattcggcagctcaagccagctattatgcttctgcgtccgcacaggctgctgcctccgctgctggttttggctcatctgtcgctaacgctgtggctagcgcttccgcttccgccgctggcggagtttcagttggagctggtgctcaagcttatgcctcagcttta

SEQ ID NO: 431 - DNA, 546 bp, Artificial Sequence
  Description of Artificial Sequence: Synthetic polynucleotide
ggtaatggactcggtcaagctttattggcaaacggtgtattgaatagcggaaattacctacaactggcaaattctctagcttattcctttggatcctcgctatcccaatactctagtagtgctgcgggagcttctgcagccggtgccgcatcaggagccgctggtgctggtgcaggtgctgcctcctctggaggaagttctggatctgccagtagctcgaccacaactactacaactacctccacaagtgcggcagccgccgctgctgctgccgcagccgctgcatctgcagctgcatcaacctctgccagcgcttcagcttcggcctccgcctctgcttccgccttctctcagacttttgttcaaacagttctacaatctgctgcattcggatcttatttcggtggaaatctttccctgcaatcagcccaagctgctgccagcgcagctgctcaagccgcggcacaacaaattggcttaggatcatacggttatgccctagcaaatgctgttgcatccgcttttgcctccgcgggtgcgaacgca

SEQ ID NO: 432 - DNA, 549 bp, Artificial Sequence
  Description of Artificial Sequence: Synthetic polynucleotide
ggttcctatgcttacgctcaggcggctgccggagcttttgccaacgtattgtttcaagctggtgtattgacatacgccaatgcttccgccctcgccagtgcctatgcaagtgcttatgctagctctgtagccagtgctgcagctagcgcttcagcaggagcctctgcatcttcaggagctagtgccagtgcaagtgcagcagcagctgcggccgctgcagctgctgcatcagcctcagccggtgcttcagcttcagccggcgcatctgcgtctgctggtgcgtccgcctctgccagtgccagtgctaccgcctctgctttcgcatcagcttttgccagcgctgtagtccaaactggatatttctctaatgtctttggcaacgtctactccgctgcacaggcctcctattacgcatctgcctcggcccaagctgccgctagtgctgctggattcggatctagtgtagctaacgccgttgctagtgcaagtgcttctgctgcaggaggagtatctgttggtgctggtgcacaggcttatgcttctgctcta

SEQ ID NO: 433 - DNA, 546 bp, Artificial Sequence
  Description of Artificial Sequence: Synthetic polynucleotide
ggtaacggattgggacaggcattgctcgcaaacggcgtcttgaacagcggtaactaccttcaattggctaattccctggcttactcatttggatcaagtttgtctcagtactcttcatcggctgccggagcaagtgccgccggagctgcctccggtgccgctggtgctggagcgggagccgcttcatcaggaggatcttcaggttcggcttcatcatcaactactacgacaactactacatctacaagtgctgccgctgctgctgcagccgcagctgcagcagcctcagctgctgcctcgactagtgcttctgcctctgcatccgcttccgccagcgcgtctgccttcagtcaaacctttgtgcaaacggttttgcaatcagctgctttcggatcttacttcggtggtaacttgagtttgcaatctgcccaagctgctgctagcgcggccgcgcaggctgctgctcaacaaattggtttgggaagttacggctatgctctggcaaacgcagtggcttcagcttttgcgtcagctggcgctaacgca

SEQ ID NO: 434 - DNA, 549 bp, Artificial Sequence
  Description of Artificial Sequence: Synthetic polynucleotide
ggttcatacgcctacgcgcaagctgcagccggtgcttttgcaaatgttttatttcaggctggtgttctgacttacgcaaatgcatccgctttagcaagtgcttatgcatcagcctatgcttcttcagttgcgtcggcggctgcaagcgcatctgcaggagcttcggcttcaagtggagcctctgcctctgcatcagcagctgcagctgctgcagccgctgctgccgcctcggcctctgctggagcctcagcctccgccggcgccagcgcaagtgctggagccagcgctagtgcctctgcaagtgcaactgcttctgcatttgcatctgcttttgcttccgccgtggttcaaactggctatttttctaacgtctttggtaatgtgtacagtgctgcacaagcttcatattacgcctcagcctcagctcaggccgctgcaagtgctgcgggtttcggtagttccgtagccaatgccgtggcatctgcttctgcctcagcggctggaggagtttccgtcggagccggagcacaagcttacgcatcggcttta

SEQ ID NO: 435 - DNA, 546 bp, Artificial Sequence
  Description of Artificial Sequence: Synthetic polynucleotide
ggtaatggactaggacaagccctattagctaatggagttctgaactcaggtaactatttgcaacttgcaaacagccttgcgtactcttttggatcctcgctgtctcaatactcaagttctgctgcaggtgcttccgcagccggagccgcttccggtgctgccggagcaggtgcaggagccgcatcatcaggtggtagctctggaagtgcttcatcctcgaccaccactactacaactacctcaacctcagctgctgcagcagcagctgcggctgccgctgctgcttcggctgcagcttctacttctgcctcagcgtctgcttctgcatcagcttcagctagcgccttctcccaaacatttgttcagactgttttacaatcggccgcatttggttcatactttggaggaaatctgtctttgcagtcggctcaagcagcagcatcagcagccgcccaagcagccgcacaacaaattggattgggttcatatggttatgctttagctaacgccgtagcatctgccttcgcctccgccggcgcaaatgca

SEQ ID NO: 436 - DNA, 639 bp, Artificial Sequence
  Description of Artificial Sequence: Synthetic polynucleotide
ggtggtgctggccaaggtggctacggcggacttggtggacaaggagctggccaaggtggttacggaggtttgggtggccagggagctggacagggagccggcgctgctgcagccgcggcagccggtggtgcaggacagggtggttacggtggtttaggttctcagggtgctggacgtggaggtcaaggagccggagctgcagctgcagctgccggaggtgctggacaaggaggctatggaggtttaggatcacaaggagccggaagaggaggccttggaggacaaggtgcaggagctgccgccgccgctgcggcaggaggtgcgggtcaaggaggttatggtggtctaggtaatcaaggtgccggaagaggcggtcaaggcgcagctgccgcagctgcaggtggtgctggtcaaggaggttacggtggactaggttctcagggcgctggtaggggaggattaggtggccaaggtgctggtgctgcagcggctgcagctggtggtgctggccagggaggatacggtggactaggaggacaaggcgctggccaaggaggctatggcggtcttggttctcaaggtgctggtcgaggaggactaggaggtcaaggtgccggagctgccgccgctgccgcagca

SEQ ID NO: 437 - DNA, 558 bp, Artificial Sequence
  Description of Artificial Sequence: Synthetic polynucleotide
ggtggtgccggacaaggtggtctgggtggacaaggtgctggtcagggagccggcgcttccgctgccgctgctggtggagctggtcaaggcggatatggtggactgggatctcaaggagccggtagaggtggtgagggagcaggtgcggcagcagctgctgcaggcggcgcaggtcaaggcggatacggaggactgggaggtcaaggtgcaggacagggaggttacggaggattgggttctcaaggtgcaggaagaggtggtttgggaggacagggtgccggcgccgccgcggcaggtggtgccggtcaaggaggtcttggaggtcagggcgctggacaaggtgccggagctgcggccgccgccgctggaggcgccggacaaggaggctatggtggtttaggttcacaaggtgctggtagaggaggattgggtggtcaaggtgctggtgctgttgccgctgcagcagccggcggtgcaggacaaggtggttatggtggtttaggatctcaaggagcaggtcgtggcggtcagggtgcaggagcagctgccgctgcggca

SEQ ID NO: 438 - DNA, 564 bp, Artificial Sequence
  Description of Artificial Sequence: Synthetic polynucleotide
ggtggtgcaggtcaaagaggttatggaggactaggtaatcaaggagctggtcgcggaggattaggaggtcaaggagctggtgctgccgccgctgctgctgctggaggtgcaggacagggtggatacggtggtcttggtaatcagggagcaggtcgaggtggacagggcgccgcggctgccgctggtggagccggacaaggtggttatggtggcttaggtagtcaaggtgctggtagaggaggtcagggagctggagctgctgccgccgcagcagtaggagctggtcaagaaggtatcagaggacaaggagctggtcagggtggttatggaggcttaggatctcagggtagcggtagaggaggattaggtggtcaaggagcaggtgctgccgctgccgctgctggtggagctggacaaggtggtttaggtggtcaaggtgcaggccagggagccggtgccgctgcggcagctgctggtggtgttagacagggaggctatggtggcttaggatcccagggtgctggccgaggtggtcagggagcaggtgctgcagcagccgctgca

SEQ ID NO: 439 - DNA, 648 bp, Artificial Sequence
  Description of Artificial Sequence: Synthetic polynucleotide
ggtcccggtggctatggacctggtcaacagggtcctggaggttatggtcccggtcaacaaggacctggaagatacggtccaggtcaacaaggaccatcaggtccaggaagtgcagccgcggctgctgctggttccggacaacagggacctggcggctacggaccacgtcaacagggtcccggtggttatggtcaaggccaacaaggtccatctggtccaggctcagctgcagcagcatctgctgcagccagcgctgagtcaggtcaacaaggtcccggtggatatggtccaggacaacaaggccctggtggatatggaccaggtcaacagggtccaggcggatacggccctggccagcaaggaccgtccggaccaggttctgcggccgctgcggctgcagctgcctcaggtcctggtcagcaaggtccaggaggctatggtcctggacagcaaggtccgggaggatatggacctggacaacaaggaccttctggacctggctctgctgcagcggctgctgccgcggcgtcgggtccaggacaacagggccctggaggatacggtccaggacagcaaggtccaggtggttatggtcctggtcagcagggactgtctggtcctggatctgctgctgctgcagcagctgca

SEQ ID NO: 440 - DNA, 636 bp, Artificial Sequence
  Description of Artificial Sequence: Synthetic polynucleotide
ggtcctggacaacaaggccctggcggatatggaccgggtcaacaaggaccatccggacctggttccgcagctgctgccgccgctgcagctgctggtcctggaggatacggtcctggtcagcaaggtcctggaggctacggaccaggacaacagggtccatccggagctggttctgcagctgctgctgcagctgcaggccctggacaacaaggattaggtggttacggaccaggacagcagggacctggtggatacggtccgggacaacaaggtccaggtggttatggacctggttctgcatctgccgctgccgccgctgctggtccaggccaacaaggacccggtggatacggccctggtcagcagggaccttccggtccaggatcggcttccgccgctgctgctgcggcggctgccggtccaggaggttatggtccaggtcagcaaggtccgggaggttatgcaccaggacaacaaggtccttccggtcctggttccgcttccgctgccgcagctgctgctgccgctggtccaggtggatacggacctggtcaacaaggacctggaggctatgctcccggtcagcaaggtccatccggtcctggatctgccgcggctgctgccgcagccgccgca

SEQ ID NO: 441 - DNA, 624 bp, Artificial Sequence
  Description of Artificial Sequence: Synthetic polynucleotide
ggtcgaggacccgaaggatatggacctaggcaacaaggtcccggagctacggctgctgctgctggacctggtggatacggcccacgacaacagggaccaggaggatatggaccaggtcagcagggaccaggtgcagcagctgccgccgctgccggtagaggaccaggtggatacggtccaggtcaacaaggaccaggtggtccaggagctgctgctgcagctgctggtagtgaaggatacggacctggtcagcaaggtcctagaggcccaggagctgctgcagctggacctggaggatacggtcctggacaacagggtgcatcagctgcagcttccgcagctgcaggaagaggacctggtggatatggacctggacagcaaggacctggaggacctagtgctgccgcagccggtcctggtggttacggtcctggtcagcaaggaccaagtgctgcagcagctgctgctgctggttctggtcctggcggttacggaccaggccagcaaggtccaggaggtcctggtgctgcagctgccgccgcgggaccaggcggatacggtccaggacaacagggtcccggtgctgcagcagcagccgccggacaagcagcggccgcggcagca

SEQ ID NO: 442 - DNA, 675 bp, Artificial Sequence
  Description of Artificial Sequence: Synthetic polynucleotide
ggtagaggaccaggaggttatggtccaggtcagcagggaccgggtggacctggagcagctgcagcggctgccggtcccggaggttatggaccaggtggttacggtccaggtcaacaaggtcctggtggtccaggagccgctgccgctgctgccgccggccgcggtccaggtggttatggtccaggacaacaaggtcctggccaacaaggcccaggtggttccggtgctgcagctgcagctgcgggaagaggtccaggtggatacggaccgggtcaacaaggccctggtggaccaggtgccgccgccgctgctgctggtccaggtggatatggtcctggtcagcagggacctggtgctgctgcagcagccgccgcagctggtagaggtcccggtggatatggtccgggccagcagggaccaggaggccctggtgccgcagctgctgctgccgctggacgtggaccgggtggatacggtcctggtcagcaaggaccaggtcaacagggtccaggcggttccggtgcagctgccgctgccgctggaagaggaccaggcggatatggtcctggacaacaaggacctggaggacctggtgccgccgcagcagctgcaggtcctggaggatatggacctggtcaacaaggaccaggagcagcagcagccgccgccgctgca

SEQ ID NO: 443 - DNA, 675 bp, Artificial Sequence
  Description of Artificial Sequence: Synthetic polynucleotide
ggtcgtggtccgggaggatacggtccaggacagcaaggtccgggtggatctggcgccgcagcagctgctgctggaagaggtccaggaggttatggtccaggacagcagggaccaggtggtccaggagcagctgcagccgctgctggtcctggtggttacggtccaggacaacaaggcacgggtgctgcggctgccgcagcagctggttctggtgccggaggttacggtcctggacagcagggcccaggtggtcctggtgctgccgcagcagcagctggacctggaggatacggccccggacagcaaggcccaggtgcagcagccgctgccgctgctggaagtggtccaggcggatatggtccaggtcaacaaggtcctggtggttcttctgctgccgccgcagccgcaggtccaggtagatacggaccgggtcagcaaggtccaggtgcagccgctgctgcttctgctggccgtggtccaggaggttacggtccgggccaacaaggtccaggcggtcctggtgccgctgctgcagctgccggtcctggaggttatggccctggtcaacaaggccctggagccgctgctgccgctgctgcaggatcaggtccaggcggatacggacctggtcagcaaggtcccggaggtccaggagctgcagctgccgcagctgca

SEQ ID NO: 444 - DNA, 648 bp, Artificial Sequence
  Description of Artificial Sequence: Synthetic polynucleotide
ggtcgtggtcctggtggctatggacaaggtcagcaaggacccggcggacctggcgcagcagctgccgcggccggtccaggtggttatggacctggacaacaaggacctggagcagcagcagctgcagccgctggatctggccctggtggatatggacctggtcagcaaggaccaggacgttcaggtgcagctgctgcagcagccgcagctggtcgtggtccaggtggatatggtccaggacagcagggcccaggaggccctggtgccgcagcggccgctgccggtcctggtggttatggtccaggccaacaaggtcctggtgcagctgcagcagctagtgctggtcgaggacctggtggatatggtcctggacaacaaggtccgggtggatccggagccgctgctgctgcagccggtagaggtcccggtggatacggtccgggtcaacaaggtccaggtggtcctggagctgctgctgcagctgccgctggccgtggtccaggtggctacggaccaggtcaacaaggccctggtcagcagggtcctggaggaagcggtgctgcggctgccgccgctggtcgtggccctggcggatacggtccaggtcaacagggaccaggtggtccaggtgctgctgctgctgccgca

SEQ ID NO: 445 - DNA, 672 bp, Artificial Sequence
  Description of Artificial Sequence: Synthetic polynucleotide
ggtcctggaggttatggtcctggtcaacaaaggccaggacaacagggccctggaggtccaggagccgctgccgctgcagcaggtcgcggtcctggaggatatggtcctggacagcaaggccctggaggtcctggtgccgctgcggcagctgcagccggaaggggacctggtggatacggacctggacaacaaggacctggtcaacaaggtccaggcggttcaggtgctgcagcagctgcagctggccgaggacccggcggatatggaccaggtcagcagggaccaggaggacctggcgccgctgccgctgctgcaggacctggaggatacggaccaggacaacaaggtcctggtgctgctgctgccgccgctgcagcaggaagaggaccgggtggatatggaccgggacaacaaggtccaggaggaccaggagcggcagcggctgcagcagctggaagaggccctggcggttatggtcccggtcagcaaggacctggtcagcagggtccaggtggtccgggtgccgctgcagcagcagccggacctggtggttatggaccgggtcaacaaggtaccggagctgctgctgctgcggctgccggttcgggagctggtggatatggaccaggacagcaaggtcctggaggccctggagcagctgcagcagctgca

SEQ ID NO: 446 - DNA, 609 bp, Artificial Sequence
  Description of Artificial Sequence: Synthetic polynucleotide
ggtccaggcggttacggtccaggacaacagggaccgggcgctgcagctgctgctgcagctggttctggtcctggtggttacggacctggccagcagggacctggcggaagcagcgctgccgctgccgctgccggacctggaagatacggtccaggtcaacaaggtccgggtgctgccgctgcagcagctgctggatcaggtccaggtggttatggtccaggtcagcaaggtccaggtggtcctggagcagctgccgctgctgccgctgccggtagaggtccaggaggatacggacctggtcaacagggacctggtggtccgggagctgctgcagccgctgctggacctggaggttatggaccaggacagcaaggacctggtgccgccgctgctgctgctgctggtagcggtccaggcggatatggtcctggtcagcaaggtccgggtggaccaggcgcagctgccgcagctgccgcgggaaggggacctggcggttacggtcaaggccagcaaggaccaggaggacctggagctgccgcagcagctgcaggtcctggtggatatggtcctggacagcagggtccaggtgctgctgctgctgcagcagca

SEQ ID NO: 447 - DNA, 561 bp, Artificial Sequence
  Description of Artificial Sequence: Synthetic polynucleotide
ggttcaggaccgggaggttatggtccaggtcaacagggacccggtcgatctggtgctgcagcagcggctgcagctgcaggcagaggtcccggtggatatggtccaggccagcaaggacctggtggtcctggtgccgcagctgctgccgcaggaccaggtggttatggacctggccaacaaggtccaggtgctgccgccgctgcttcagccggtagaggaccgggtggttacggaccaggtcagcagggacctggaggttcaggtgcagctgcagcagctgctggacgtggccctggaggttatggaccaggacagcaaggcccaggcggaccaggagcagctgctgctgccgctgctggtactggaccaggaggatatggtccaggtcagcaaggtcctggaggctccggtgctgctgccgcagcggctggtaggggtccaggtggttacggacctggacaacaaggaccaggtggtcctggagctgcagcggctgcggctggcccaggaggatatggaccaggtcaacaaggacctggcgctgctgctgctgcggcagca

SEQ ID NO: 448 - DNA, 522 bp, Artificial Sequence
  Description of Artificial Sequence: Synthetic polynucleotide
ggtagcggaccaggaggttacggaccaggccaacagggaccaggtggaccgggcgctgcagccgccgccgctggaagaggaccaggtggttatggtcctggtcagcagggaccaggtggtccaggtgcggccgctgctgctgccgcaggacgaggacctggaggatacggtcctggccagcaaggacctggtggttccggtgctgccgctgccgctagtggtaggggtccaggtggtagtggtcctggtggatacggtcccggtcaacagggaccaggagcagccgctgctgctgctgctgcaggtagaggtcctggaggttacggacctggtcagcaaggacctggaggtccaggtgctgccgctgctgccgcagccggtagaggtccgggaggatatggtcctggacaacaaggtcctggtggttctggagccgccgctgctgccgctggaagaggtcctggtggctatggtcccggtcaacaaggacctggcggacctggtgctgcagctgccgcagca

SEQ ID NO: 449 - DNA, 468 bp, Artificial Sequence
  Description of Artificial Sequence: Synthetic polynucleotide
ggtccaggaggttatggtcccggtcaacaaggtcctggagccgctgccgctgcagcaggtagaggacctggcggctatggacctggacaacagggcccaggcggttctggagctgccgcagctgccgcgggaagaggtccaggtggttatggtccaggacaacaaggacctggtggtcctggagctgccgctgcagctgcaggtcccggcggatacggaccaggacagcagggtaccggtgctgctgctgccgcggccgctggttctggtgccggtggttatggtcctggtcaacaaggaccaggaggtcctggagctgctgctgcagctgctggaccgggtggctatggaccaggccagcaaggccctggtgccgccgccgctgctgccgcaggtagtggcccaggcggttatggtccaggtcaacagggacctggtggacctggtgctgctgccgcagcagctgca

SEQ ID NO: 450 - DNA, 525 bp, Artificial Sequence
  Description of Artificial Sequence: Synthetic polynucleotide
ggtggtgccggtcaaggaggttactctggacttgatagacagagatctggcgccgctgccgctggagcatcagtggcagctcagggtggttacggtggtcttggaggccaaggagccggtgcagctggcgctgctgccgcaggtggtgctggtaggggtggatatggtggtttggttggtcaaggagctggtgctgctgctgctggtgctggagaagccggacagggaggctatggatctttgggtggacaaggtaccggtgcaggtggcgaggctgctgctgcaactggaggcgctggtcagggcggttacggtggactaggtggccaaggtgcttctgcagccggatcagccggtcaaggtggttatggtggattggccggacaaagagcaggagctgctgccactggcggtttgtttgatggatctagagatgttggtggtttctcattcgcagtttctggttcttcaggtggctaccgtagaggaggttacgttggtaatagcacagccgctgcagctgca

SEQ ID NO: 451 - DNA, 531 bp, Artificial Sequence
  Description of Artificial Sequence: Synthetic polynucleotide
ggtggtgcgggtcaaggcggttacggaggattaggaggtcaaggagccggtgctgctgctgccgctgcaggaggagccggacagggaggttacggtggtcaaggtgccggacaaggagcggctgccgctgcagcatcaggtgctggtcaaggaggctatgaaggtcctggtgcaggacaaggagctggtgctgcagctgccgcagccggtggtgccggccagggaggatatggtggtttgggcggacagggcgccggccaaggagctggtgcagccgcagccgccgctggcggtgccggacaaggtggttacggtggtcttggtggtcagggagcaggtcagggtgcaggagccgctgctgctgctgctggaggagctggtcaaggcggatatggaggtcaaggcgcaggtcaaggcgcagcagcagcagccgctggtggagccggacagggtggttacggcggcctaggttcaggacaaggaggttatggacgtcagggagctggtgccgcagccgcagcggccgctgca

SEQ ID NO: 452 - DNA, 522 bp, Artificial Sequence
  Description of Artificial Sequence: Synthetic polynucleotide
ggtggagcaggccaaggtggatacggcggtttgggcggccaaggtgctggcgccgctgctgcagctgctggtggagctggacaaggaggatacggtggtcaaggagccggtcaaggcgctgctgctgcagcagcctctggagccggacagggtggatatggcggtccgggcgccggtcagggcgcaggtgctgcagccgctgcagctggcggagctggtcagggcggttacggtggactcggtggacaaggagctggccagggagccggtgctgctgcagccgccgcaggtggagctggccaaggtggttacggaggtcaaggcgccggacaaggtgctgccgcagctgctgctggtggtgctggacaaggtggttacggtggtttaggatccggtcaaggtggatatggtggtcaaggtgccggagcagcagccgcagctggcggagccggacagggaggatatggaggtttgggtggacaaggcgctggccaaggagcaggtgcagcagccgccgctgca

SEQ ID NO: 453 - DNA, 444 bp, Artificial Sequence
  Description of Artificial Sequence: Synthetic polynucleotide
ggtggctacggtcctggtagcggtcagcaaggcccaggcgctggtcaacaaggtcctggtgcaggacagcagggaccatatggaccatctgctgcagcagcagcggctgctgctggcggttacggccctggaggagctggtcagcagggaccaggtgccggtcaacaaggacctggatcacagggtcagtccggtcctggtgccactgtcgctgctgctgctgccggaggatatggcccaggtggtgccggacagcaaggtcctggagctggacaacaaggtcagggatctcaaggaccttatggaccagcggctaccgccgctgccgctgctgctggtggttacggaccaggaagtggccagcaaggtccaggagccggtcaacaaggtccaggaggacaaggaccatatggtccatctgccgctgcagctgctgctgccgca

SEQ ID NO: 454 - DNA, 438 bp, Artificial Sequence
  Description of Artificial Sequence: Synthetic polynucleotide
ggtggatatggtcctggtagtggacaacaaggacctggagccggtcctcaaggaccaggttctcagggtccgtatggtcctggagcagccgctgccgctgcagctgtgggtggctacggtcctggatctggtcaacagggaccaggtgcaggtcaacaaggtccaggcggacaaggcccatacggaccaagttctgcagcggccgctgctgcagccggtggatacggtccaggaggagcaggtcagcaagtaccaggtgccggccaacagggtccaggaaatcagggtccatcaggacctggagctgcagcagctgctgctgctgccggaggttacggccctggaggtgctggtcaacagggcccagctgcaggccaacagggacctggctcacaaggatcgtatggaccgggtgctgcagccgctgcagctgctgca

SEQ ID NO: 455 - DNA, 579 bp, Artificial Sequence
  Description of Artificial Sequence: Synthetic polynucleotide
ggtggtcttggaggtcagggaggtctgggtggactaggtagtcaaggagctggtttgggcggctatggtcaaggtggtgctggccaaggaggagctgcagcagctgctgctgccgccggtggtttaggaggacaaggaggtagaggaggtttaggctcccaaggtgcaggccaaggaggttatggtcagggaggagctggccaaggaggtgctgctgccgcagctgcagcggccggtggactaggaggtcaaggtggactgggagcccttggaagccagggtgccggccaaggtggcgctggtcagggtggttacggacaaggaggcgcagccgcagctgctgctggaggcctcggaggtcagggtggtctaggaggattgggttctcagggagccggacaaggtggatatggccaaggtggcgccggtcaaggaggagctgccgctgctgcagcagcagctggtggtttaggtggtcaaggcggtctgggcggtttaggttcccaaggagccggtccgggaggttatggacaaggtggtgcaggtcaaggtggagcagctgccgccgctgccgcggca

SEQ ID NO: 456 - DNA, 498 bp, Artificial Sequence
  Description of Artificial Sequence: Synthetic polynucleotide
ggtggtttgggcggtcaaggtggtttaggcgctcttggcagtcaaggtgctggtcaaggcggctatggacagggtggagctggccaaggtggtgctgcagccgcagctgccgctggtggactaggtggtcaaggcggacttggtgctttaggtagtcaaggtgccggacaaggtggttacggccaaggaggttcacaaggtgccggccagggtggttatggacaaggtggcgctgctgcagccgccgctgctgcaggtggcctcggtggtcaaggtggacttggtggactaggaagtcagggagccggacaaggaggttacggacagggtggtagccagggtgctggacaaggaggtgcagctgctgctgctgctgcagctggtggtctgggaggtcagggaggcttcggtggtcttggatctcagggcgccggacagggtggctatggacaaggtggagcaggacaaggtggtgctgctgccgccgctgcggcagca

SEQ ID NO: 457 - DNA, 723 bp, Artificial Sequence
  Description of Artificial Sequence: Synthetic polynucleotide
ggtgcaggagctggtcagggcggacgaggcggctacggtcaaggaggatttggaggacaaggctccggtgcaggtgctggtgcaagcgcagctgcaggtgcaggagctggccaaggtggaagaggaggttacggacagggtggtttcggtggtcaaggttccggtgccggagctggagcttccgctgcagctggagctggtgctggtcaaggaggtagaggaggctacggacaaggcggttttggcggacaaggttcaggtgccggtgctggcgctagcgccgcagctgctgccggtgcaggacaaggtggaagaggcggttacggtcaaggtggacttggtggttcaggatctggtgctggagccggtgctggtgctgctgccgccgcagctgctggcgcaggaggttatggacaaggtggattaggtggttacggccaaggcgccggcgctggacagggcggcctcggaggttacggatcaggagcaggagccggtgcctcagccgctgcggctgcaggtgccggaggtgctggacaaggaggtttgggtggttatggtcagggcgcaggtgccggtcaaggtggtctgggtggttatggcagcggtgctggtgcaggagcagcagccgctgccgcagccggagccggaggctctggtcaaggaggactcggtggttatggctctggaggtggagctggaggagcaagtgccgctgctgca

SEQ ID NO: 458 - DNA, 498 bp, Artificial Sequence
  Description of Artificial Sequence: Synthetic polynucleotide
ggtgcgtctgattcagcagcagctgcagctttatctgctgctagcgcaagtgcagcatctgccgcgacagctgttagtactacaacatcaacttccacgtcagcagctactgccgccgcagctgccgcttctgctgcaggcgctgctggcgcaggagctgccgccggtgcaactgcctcaagctccttcggccaaaatttgctttccggcttgctgagatccgacgccgtcgtctccgccctttcacaggcttattctgcatcaactgcatccgccctagcatcatcttacgctcaatcaggagctgatcgtgctggattcggcaattatggatctgtgattgctagcgccgcggctagcgctgttgcttctgcaggaaacaacgctggtgcctatgcctatgcaagagcctatgcatcagctatctcacaatctctttcaagccttggaattcttaattcaggtaatgcaattgctttggccaacgctttcagttca

SEQ ID NO: 459 - DNA, 498 bp, Artificial Sequence
  Description of Artificial Sequence: Synthetic polynucleotide
ggtgcttctgattcggctgcggctgctgctgtttctgccgcttctgcttctgcggcatccgcagccactgcgagtagtaggacgacgagtacttcaacttcagctgctactgcagctgctgccgctgctagtgctgcaggctcagcaggtgcgggagcagctgcaggagctaccgccagtagttccttcggtcaaaatttgctgtctggactgctccgtagtgacgcagtggtgagtgcactatcacaagcctattcggcttctactgcaagcgcactagcttcctcttacgctcaatccggtgccgatcgtgccggtttaggtaattatggaagtgtgattgcctctgccgcagccagtgccgttgcgtcagctggtaataacgctggagcgtatgcttacgctcgcgcatacgcctcggctatatctcaaagtttgagctcgctgcgaattctaaactctggaaacgccattgccctagcaaatgcattctcatca

SEQ ID NO: 460 - DNA, 498 bp, Artificial Sequence
  Description of Artificial Sequence: Synthetic polynucleotide
ggtgcttcagactcggctgcagctgctgctttgagtgctgcctcggcaagtgcagctagcgctgctactgctgcttctactactactagcacatcgacttctgcggcaacagctgcagcagcagctgcatcagccgccggagctgctggtgcgggtgcagcggctggtgctacagccagttcttcatttggacaaaacctactcagtggattgttaagatcggacgccgtcgtgtccgctctttcccaggcatattcggcaagtacagcttctgccctcgcatcatcctatgctcagagtggtgctgatagagcaggcctaggtaactacggatcagtgatcgctagtgctgctgcctctgctgttgcttctgctggtaataatgctggtgcttacgcgtatgctagagcttatgcatccgccatcagccagtcattgtcatcactcggtattctaaactctggaaatgctatcgcactagctaacgcttttacttca

SEQ ID NO: 461 - DNA, 522 bp, Artificial Sequence
  Description of Artificial Sequence: Synthetic polynucleotide
ggtggattgggtggtggacagggtgcaggtcaaggtggacagcaaggcgctggacaaggtggctatggtagcggactgggtggtgccggccaaggagctggacaaggagctagtgcagctgctgccgctgctgccggtggtctaggtggaggtcagggtgcaggccaaggtggtcaacaaggtgctggacagggaggttatggatctggactcggaggtgctggtcaaggcgcttcagccgctgcagctgccgccgcagccggtggattaggtggaggccagggtgccggacaaggaggacaacaaggagcaggacagggaggatacggttcaggtctaggtggagctggacaaggtgcttcagctgctgcagctgctgctgcagctggtggtttgggtggaggtcagggagcaggccaaggaggccagcaaggtgctggtcagggtggttacggatcaggtttgggaggcgctggtcaaggagcaggtcaaggtgctagtgcggccgctgctgctgccgca

SEQ ID NO: 462 - DNA, 531 bp, Artificial Sequence
  Description of Artificial Sequence: Synthetic polynucleotide
ggtggttctggaggtcaaggaggacagggcggttatggatccggaggtcaaggtcagggacaaggtggttatggaagcggagccgctgcagccgcagctgccgcagctggaggatcaggtggtcaaggtggtcagggaggttacggatctggcggacagggtcaaggtcagggtggttacggcgcaggtgctgcagcagcggctgcagccgccgcaggtggttccggtggtcaaggcggagccggtgctggtggccaaggcggacaaggtcaaggacagggtggttatggttctggagccgctgctgccgctgcagccgctgctggtggactcggaggacaaggtggatacggttctggtagacaaggtcagggtcaaggtggttacggctcaggtgcggccgccgctgcagctgcggctgctggtggcagcggaggtcagggtgcccaaggtggatacggatccggtggtcaaggacaaggtcagggaggatatggttccggtgccgctgctgctgccgccgctgccgca

SEQ ID NO: 463 - DNA, 567 bp, Artificial Sequence
  Description of Artificial Sequence: Synthetic polynucleotide
ggtggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggaccaggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgca

SEQ ID NO: 464 - DNA, 378 bp, Artificial Sequence
  Description of Artificial Sequence: Synthetic polynucleotide
ggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaaggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgca

SEQ ID NO: 465 - DNA, 945 bp, Artificial Sequence
  Description of Artificial Sequence: Synthetic polynucleotide
ggtggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggaccaggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgcaggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaaggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgca

SEQ ID NO: 466 - DNA, 1890 bp, Artificial Sequence
  Description of Artificial Sequence: Synthetic polynucleotide
ggtggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggaccaggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgcaggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaaggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgcaggtggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggaccaggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgcaggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaaggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgca

SEQ ID NO: 467 - DNA, 2835 bp, Artificial Sequence
  Description of Artificial Sequence: Synthetic polynucleotide
ggtggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggaccaggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgcaggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaaggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgcaggtggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggaccaggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgcaggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaaggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgcaggtggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggaccaggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgcaggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaaggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgca

SEQ ID NO: 468 - DNA, 464 bp, Artificial Sequence
  Description of Artificial Sequence: Synthetic polynucleotide
gaagacttagcaggtgcagcgtctgcatctggtgctgcgagcgcctctggtgcagcatccgcgtcagaagcagcaagttcttcctccacaaccataactactaaaggcacttctgcatcgggacttctatcttccccatatggctcggtcagtatttcggttgaaaatagaattatctctttgatatcgtcaatcttgagcgagttcatttctatcgagtccgcttttaactattcctcattcgctaaaaagctggcctttttggcatctgagatctcggtgtccaatccaggtctttctgctagtgaagtcattagtgaggtattgttggagacagtgacagctcttatccacatcttggcaagtagtcaagtgggttcagtctcaacagccgatttgagctctgtttcaagagcctttgctcagtcgttcgcccaggctttcgcacaccaaggtacgtcttc

SEQ ID NO: 469 - DNA, 563 bp, Artificial Sequence
  Description of Artificial Sequence: Synthetic polynucleotide
gaagacttagcaggtgcagcagctacttctagtagtaccactgctgcatcttccgctggctcctcgtcgagtgtatcttcaatttcggcaggtgtgtcctctgatgccggcggcgcctatctatccggagacgtttccgaattcggatccagcggtagtttgccacaagctgtgctcccactgtctcaatggccaggtactggttcttcgggagcagatctattgatatcagatctcctcagtttgagagatggattgctatccagctctgcgtcagagagaatttctgctattattttgccattggtttctgcattatctccgactggagtaaacttctcagagataggtaatattattctttccttaataagtaagataagcggatcatgtgtcggtttatcgccgtctcagaccttttccgaggcattgctggaagttattattgctctaatgcagattttgtcctccgccaaggtcacgacagtatcaacaagtgctagcggaaccgcaagatccttggctcagagtctatcatcagctatggctggaggtacgtcttc

SEQ ID NO: 470 - DNA, 533 bp, Artificial Sequence
  Description of Artificial Sequence: Synthetic polynucleotide
gaagacttagcaggtgctagctccacaactaccacaacggaggctacaggcagtgatgcgtcagcaagaagaatatcgtccggagcatcttccgaaactgccgcgtcatctgtggtagatagttcagtattttccggtgacgtgtcagactactctggtttcaatgtattacctttggtcagcgatctattgtccagttcttcaggattatctagtccagctgccattagacgcatcgactctcttattccattgttgttttcctcagcatcctccaataatttgagtgcatcattcctatccaacgtgttggctactagtgtttctcagatctccgaaggttcatcgggtttatcagctactcagattatcattgaggctttgttcgaactgattagcggactaatgcatattctgacctctgcccactttgacgcagtttcaagggccacatcctcggccacagcctctgcactggccaactcactgtctactgcattttcaggagttaataatatcgcaggtacgtcttc

SEQ ID NO: 471 - DNA, 479 bp, Artificial Sequence
  Description of Artificial Sequence: Synthetic polynucleotide
gaagacttagcaggtgcaggtgcaagggctgctggaggctacggtggaggatacggtgccggtgcgggtgcaggagccggcgccgcagcttccgccggagcctccggtggatacggaggtggatatggtggcggagctggtgctggtgccgtagcaggtgcctcagctggaagctacggaggtgctgttaatagactgagttccgcaggtgcagcctctagagtgtcgtccaacgtcgcagccattgcatctgctggtgctgccgctttgcccaacgttatttccaacatctatagtggtgttctttcatctggcgtgtcatcctccgaagcacttattcaggctttgttagaagtaatcagtgctttaattcatgtcttaggatcagcttctatcggcaacgtttcatctgttggtgttaattccgcacttaatgctgtgcaaaacgccgtaggcgcctatgccggaggtacgtcttc

SEQ ID NO: 472 - DNA, 458 bp, Artificial Sequence
  Description of Artificial Sequence: Synthetic polynucleotide
gaagacttagcaggtggacagggtggtcaaggaggttacggaggactaggaccgcagggtgctggcggcgccggtcagggtggatatggcggtggctcattacagtatggcggacaaggccaagcgcaagcggcagcagcttctgccgctgctagcagattgagttccccatcagctgctgcaagagtctcctccgctgtaagcctcgtgtcaaatggaggacctactagtccagctgctctgagttcgtctatttctaatgtagtatctcaaatttccgccagtaacccgggattgagcggatgtgacatattggttcaagctctattggaaattatcagtgcacttgtgcacatactgggctcggccaatattggccctgttaattcatcctcagctggtcaatccgctagcatcgtgggccaaagtgtatacagagcactctcaggtacgtcttc

SEQ ID NO: 473 - DNA, 485 bp, Artificial Sequence
  Description of Artificial Sequence: Synthetic polynucleotide
gaagacttagcaggtggttacggaccaggatcgggtcagcaaggaccgggacaacaaggtcctggtcaacaaggcccaggaggtcaaggtccatatggacctggtgcagccagcgcagctgtttctgtcggtggctatggtccccagagctcttccgttccagttgcttccgcagtggcatctagacttagttctcctgccgcgagttctcgagtcagttctgctgtgtcatcattagtatctagcggtccaactaaacacgcagctcttagtaacaccattagctctgtggtaagccaggtatctgctagtaatcccggattatccggatgtgatgtactggtccaggcattgctggaggtggtcagtgcattggtttccatcttgggcagtagtagtatcggtcaaattaactatggtgccagcgcccagtacactcaaatggtaggacagagtgtggctcaggccctagcaggtacgtcttc

SEQ ID NO: 474 - DNA, 425 bp, Artificial Sequence
  Description of Artificial Sequence: Synthetic polynucleotide
gaagacttagcaggtagtggaccaggaggatacggccctggctcacaaggtcctagcggtcctggttaccagggtccctcaggtccaggtgcatatggaccttccccatcagcttcagcttcggttgctgcatctgtctacctgagacttcaaccacgtctggaagtatcatccgctgttagtagtctagtatcgagtggtccaacaaatggtgctgcagtaagtggagctctgaactctctagtttctcagatttccgcatcaaacccaggtttgtccggttgtgacgcgctagttcaagctctgcttgaactagtctctgctttggttgcaattctctcttccgcgtcaataggccaggttaacgtttctagcgtctcacaatcaacacagatgatttcgcaggctctgtcaggtacgtcttc

SEQ ID NO: 475 - DNA, 626 bp, Artificial Sequence
  Description of Artificial Sequence: Synthetic polynucleotide
gaagacttagcaggtagtgctacctcatcaacaactactactacaaccgtatccaagagtgcagctgctgcagcggctgccgcagccgccgcgtcctccgcttcatctgcttccagagacagcgataggtcctcgagcgcagcaaaagcatacgcatcgtccagtgccaatgcttcttcgaacttcgaaaactaccaaacttctgacctaagcaggccatacgcaacttcctctaacgctccggcatctacgtcaggtatcaagaacgacttatcccctctgatttccggtttaatatcgtctagttctggtttgggttcatctgatgcatccgaccgcatctcatatttgttaacctccttgttgtctgtcattaattcagagggaggaagaatagatttcgcagcggttgcgaacattctcgtaagtttggttagcgagataagagccaagaatagtgaattgtcatacttccacatcttgattgaggcactattcgaggttttgtctgccgttctacaaattatttcttcttctcatatcgttatcggtaatgctagtttttcaagctcttctaacctagcctttgccgatgcatgtgccaaggcattctcaggtacgtcttc

SEQ ID NO: 476 - DNA, 584 bp, Artificial Sequence
  Description of Artificial Sequence: Synthetic polynucleotide
gaagacttagcaggttctgctgaggcttcctctgttgcccgtttgagttctgcatcaaatgacgtctatggcccaaccgctgaagaatttggtgcatcaggaagtgcgctcggtgtgtcccagtacggtgaattcggaggattggacgaagtcagtggaccagcacttcagagcactagtccgcccttcctaccactgacctccgacattggtcgcttcagcccagagatttctaggctgctctcgagcccaagcggactcacatccgaggcagctaaggaaagaatatcatccattattgcctctttgctcagcgctaaatcgtctcaagattttaatgccctcttactgtctaacatccttccatccttaatatccaaaattagccaaagagcatccggactttctccaaccgaaatggtgacggaagccctccttgaagtgctagcaggatgtatggaaatcttgtctagctttaatgtgggtgctcagtccattagtagtagtcgtacttcttcaaatgcacttgttcagtctataagtaaccaatttagtggtctgaacgctgctgcaggtacgtcttc

SEQ ID NO: 477 - DNA, 539 bp, Artificial Sequence
  Description of Artificial Sequence: Synthetic polynucleotide
gaagacttagcaggtgcttcttccgctgaaagtcgtaccagtgctgctcagtccggaacctcaggttctgcattaggagtcagtctatatggaggcagtggcagcttctatcaaggtaccgcaccggagttgctttctacatcccctgcctcatctcctgtagtgtcagacattggtccagaactgagctctttgctgtctgcacccacaggtctgacttctgaagcagctaaggaaagaatagctagtattattccatcgttactatccgctatttcgccaaacgagttcgacgcagttttattgtctgattccctagcttccttaataagccaaataagtcaatcaggaagcggtcttagtacgtctcagatcgccatggaagctctgttggaggtgttagcaggatgtatggaaatactgtcgagctcgaatgtcggtgccgcctcagtttcttcttctagggcttcatcgaacgccttggtgcagagtatctcaaacgcattcagtggcttaaacgcggccgcaggtacgtcttc

SEQ ID NO: 478 - DNA, 560 bp, Artificial Sequence
  Description of Artificial Sequence: Synthetic polynucleotide
gaagacttagcaggtagagccgttgcaagtggagcagccggatctggagcatcatctgccgctagatctggtgcgtctggatctgcatcaggtgtagcgaagtacggaggatacggtggatccagtgatctgagcggcccagccttccctaagattagcccagtctctttgccccatattcctgacggacgtccattcctgccggtaacatctgacctactctcgagtcctgctgatttaactagtccagccgcaaatcaaagaatcacttctataattcccattttgagatcaggtatctcacctaagggattcgatgcatcactgttagccgactccttatcaagtttgatttctgaaatttcacagtctgcttcagagcttagcgcttctgatgtactaaccgaggctctacttgaattagtctccgcgttccttcaaattttaagttccgatgctggtagtgttggtatatcgagttctacagctttctcaaatgctctagctcaatcagtttctaatgctttctatggtctgaacactgttgcaggtacgtcttc

SEQ ID NO: 479 - DNA, 479 bp, Artificial Sequence
  Description of Artificial Sequence: Synthetic polynucleotide
gaagacttagcaggtgcaggagttggagctggagttggtgcgggtgcaggtgctggcttcggtgctggcgttggcgccggagtaggagcaggatatggagctggcctgggtgctggatctggagtcggttatggatcaggatcctccattgtttctacttctggaggtgattttagcacaactcttagttcagcttcctcagttttagcaagcccacaaagcgtcacaagggtatccgctttggtccctaaccttatttcaggaggatcttttaattccaacgcagtttcagctgtgctgccaggattgacatctcaaatcaaggctgccacaggttctaatggatgcgactcattcgtgatcgcgttgttggagattgttagcgctttaggccatcttcttaataactctatgatcaacgttaacgccgcaagcgttcctgtgtcccctccacaatggctttactcaggtacgtcttc

SEQ ID NO: 480 - DNA, 554 bp, Artificial Sequence
  Description of Artificial Sequence: Synthetic polynucleotide
gaagacttagcaggtgctggagttggcgcaggagccggagcaggagctggtgctggtgtaggtgccggtttcggtgcaggtgttggtgctggcgtcggtgccggagccggtgcaggagttggagctggcgtgggcgctggtgcaggagctggattcggagccggtgttggagccggagtaggagcaggtgtcggtgctggatacggcgccggactgggttcaggcgtcggtgcctccttcggtggcgactttcgtacaacgctgtctagtgcaagtagtgttcttgcaagtcctcagtctctgactagagttaacaccctagttccatcattaatctcaggaggatcatttaatagtaatgctgtttcacgtgccttatccgatcttaactcccaaaatcgcgccgctggtagtacgggttgtgattctactattcaaacattgtttgagatggtttctgctatggaccatatccttaagaactccattatctcagataccgctgcttccgttccagtttcccctccacaatggttatattcaggtacgtcttc

SEQ ID NO: 481 - DNA, 509 bp, Artificial Sequence
  Description of Artificial Sequence: Synthetic polynucleotide
gaagacttagcaggtgctagttcctctgctgcggctgcagctgctaccggtggaggtggagccggtggttacggaccaggtataggtggaggctatggtccagcttctccgactggtaccggttccggactgggttccggcgcaggagcagtatcccctgcaagtggaactggtttaggtggatatggaggaggatccttggaatcttctataagtggtctaagttcacaagccagcgccacacgcgtttctagcctgtcctcttcactcacttcaggtggcactcttaatctggccgcgttaccaaatcaactacaacaatccgccagtgaaatatcagttagttccccaggtgcatctagctgtggcacaatggtgcagttactgttggaattgtcatactctctgatctatgccttgagtagtgcatacggtaccgacgcttcttacgttaacgaggcaatgaacaacatattccatattttgaatgcctttccaggtacgtcttc

SEQ ID NO: 482 - DNA, 431 bp, Artificial Sequence
  Description of Artificial Sequence: Synthetic polynucleotide
gaagacttagcaggtgccggaggtgccggtggcggacaaggaggatacggtggtcaaggtggttacggtcagggtacaggagcaggtggagcctcatccgctggtcttagcgtcacagttggaaatatggtttcacgtctgtcgtctccggaagctgcctcgcgcgtatcctccgcggtgtcctccctagttagtaacggccaagtgaacgttgacgcactacctagcataataagtaatttatcttctagtatcagcgcaagtgccactaccgcttcagactgcgaggttttggttcaggtacttcttgaagttgttagtgcattagttcagattgtctgttctgccaacgtcggttacattaatccggaggcatctggctctcttaacgcagtaggttcagccttggcagctatgggaggtacgtcttc

SEQ ID NO: 483 - DNA, 740 bp, Artificial Sequence
  Description of Artificial Sequence: Synthetic polynucleotide
gaagacttagcaggtgcttatgcatacgcttacgccattgcaaacgctttcgcctcaatcttggctaatactggactactcagtgtttcttcagctgctagtgtcgcttcatccgttgcctccgccatagcaaccagtgtaagttctagttccgccgctgcagccgcttccgcatccgcagctgcagctgcatcagccggtgctagtgctgccagttctgcatccgcctcttcttcagcaagcgctgccgcaggtgctggagcgggtgctggtgccggagccagcggcgcatccggtgctgctggcggatcaggcggtttcggtctgagttcaggtttcggtgcaggtatcggtggtttgggtggatatccatccggagctcttggaggcttgggaataccatccggtctgctatcttcaggattactatctccagctgccaaccagagaatagcaagtctaattcctttgattttaagtgccatttcacctaacggtgttaacttcggtgtcatcggctccaacattgcatcactagcgagtcaaatctctcaaagtggtggtggtatcgctgcttctcaggcttttactcaagctctcctagaattggtggcagcatttatacaagttctttctagtgcacaaattggtgcagtgtcgtcatcttctgcttctgcaggtgctacggccaatgcattcgctcaatctctgtcctcggcattcgcaggaggtacgtcttc

SEQ ID NO: 484 - DNA, 461 bp, Artificial Sequence
  Description of Artificial Sequence: Synthetic polynucleotide
gaagacttagcaggtgcaggagctggtgctggttcaggtgccggtgcgggagcgggtgctggtgccggtagcggtgcctcaacctcggtcagtacatcttcatcgtctgccgctggagctggagccggcgccggaagtggtgcaggagccggctcgggtactggtgcaggcatagccctcccatcaatcgtattgtcacctgctgcatcttctagaatttcttcggtttcttcatctgtacaatctgctggatcgggattgagttttagctcattgagtaatacattatcacaaacagcaagcgctatacgtagctcaaatccacagctgtcctcttctgacgttctcatccaatctttggtcgaaattattgttggactggttcaagcatttactggatcttcagcttcagcgcaaacgttcgtaaactccctgtcacaggtggccggaggtacgtcttc

SEQ ID NO: 485 - DNA, 575 bp, Artificial Sequence
  Description of Artificial Sequence: Synthetic polynucleotide
gaagacttagcaggtcagggaacagatagttcggcttcgagcgtctcgacatcaacttcagttagttcatctgcgacaggacctggttcgagatatcctgtaatggactacggtgctgatcaggctgaagcggcagcctcagctgctgcagcagcagctgccgaagcagctactattgctggactggattacgaaggtcagggacagggcacagattcaggtgcctcatccgtttcttcttctacatcggtaagttcctcagcaacaggtgttacgcagactactatagcgctgcctccagatgtcagtgccagaatttcgttcctcacttcctacttgcagtcagccggttccggattatcactctacactctatctaatttgttgtctcaaaccgctttggccatttctaaatctcgacctgaactgagtccaaacgaggtactgattcaaagtctagcagagattattgtagctcttgtgcaagcattgacaaagcaagctagttcttccgccagtgtgcagtacttcggaagattcaattctttgagtcaggtcgcgggaggtacgtcttc

SEQ ID NO: 486 - DNA, 419 bp, Artificial Sequence
  Description of Artificial Sequence: Synthetic polynucleotide
gaagacttagcaggtactgtcgctgagagtggtagtactgctgcctcttcgtcctacgccgcagcggccgcggctagttcctctgctggcagcacatcgtccccgtcgtttctaagtgctgattcactgagttcgtcccttgcttctttaagaatctgttcattctcatccaaattgatgtctagtttgtacagtggagatggtttggacattgctgaattttcagacgcagtgtcatccatggtatccagcattaagtctagcaaccctggagtatcagcttctcagatactgacggaactactgtttgaggtaattgttgcctttgttcaggccttgactaaaagcaaattttccacaatggagacagccgagtcgcttattgctgcttttgctcaagctttcgtaggtacgtcttc

SEQ ID NO: 487 - DNA, 602 bp, Artificial Sequence
  Description of Artificial Sequence: Synthetic polynucleotide
gaagacttagcaggtccaaaggaagaacctttgggtgaaagctcagttattgctactagcgtttctgccgcttcttctgttagttctggtggcgctccaggcgtacagggtggaggcccagtgacagtgtcatacagagaaggaccttctcaaattcctagtcaacaaaccttacttcaagccgttcctagcacgcaaagtgttggatccggtgtaccggttggtccgaaccaatatgaaatggtttacgcaccactgcaacagtttggtggtgtttcagcttcaaacttgctttcaccttccgcacactcaagaatcgcatccctgatgtcagacgttctttcattgttttctccaggtaactctggattcaactatggaggattcgcaagggctctttcttcagttgccagagccgtaagccaatctaatgctaagctttcgactactgatgttatcatccaggtccttatggaagcattagtggctttaatagagctgttgtccggtgctaagatcggagtggtccacccagttagagcccaagcgggtgcaagcgcatttgcacaacactttggatctgctttcggaggtacgtcttc

SEQ ID NO: 488 - DNA, 731 bp, Artificial Sequence
  Description of Artificial Sequence: Synthetic polynucleotide
gaagacttagcaggttctttgggataccaactagccctacaaagggctaactctttgggcataccgaatgccgcttctgtggctggcgcagtagctgaagcggtttctgcagtgggtgtcggagctagctcatacgcttatgcctctgcaatttcaaacgcagttggtccgttgttgatatcgcagggactgctgtctcagtccaacgcttcagcgttggcgagttctttcgcatcagcatttgcggctagtgctgtaagtagctcgtctagttctggttctacttcacaaacattgggttcatacttattgggaactcgacctgctttatcaagcaggcttggcttgttgaatttgcctagcagtgttgccgtaactagacctgcctttgtgtccttgatatcacctgtgctatcctctgaaaccggtctatcttctgcgtctgcctctagtagagtcaacagtctggccagttctgttgcctcagccatagctagcggccaggccttaagcgctgactctttcgctaagtcgctattgatacaagcctctcagattcagagttcggctccaagttttaaggcagatgacgttgttcatgagtcacttttggaaggtattagtgctcttattcaagtaataaactctagttatggaagcccactatccctaagtaatgcacaaaccgttaatgctggtctggttaattacttcttggtaggtacgtcttc

SEQ ID NO: 489 - DNA, 638 bp, Artificial Sequence
  Description of Artificial Sequence: Synthetic polynucleotide
gaagacttagcaggtaatgttggctaccaattgggtctaaaagttgctaattccctaggactaggtaacgctcaggctctggcatcccaaggcattttgaacgcggccaatgcaggatccctagcatcctcttttgccagtgcgcttagcgcttctgcaggctcggtgggaaacaggtcgagcgcgggaccatctgccgtcggactgggaggtgtatcagccgtgccaggatttattagcgctaccccggtggttggaggtccggtgactgttaatggtcaggtactaccggccgccttacagacggctttggcccctgttgtgacatccagcggattggcatcctcagcagcttctgccagagtgagttcgttagcacaaagtatagcatccgcgatctcttcttctggcggtacattatctgtccctatattcttgaatctcttatccagtgcaggcgcacaagcgactgcttcctcatccctctcttcgagtcaagtaacgtctcaagtattattggaaggaattgctgccttgttgcaagtcattaatggtgcccaaattagatccgttaacttagctaatgtgcctaacgttcaacaagcccttgtttctgctctatctggaggtacgtcttc

SEQ ID NO: 490 - DNA, 737 bp, Artificial Sequence
  Description of Artificial Sequence: Synthetic polynucleotide
gaagacttagcaggtaacgttgcgtatcagctaggctttaacgttgcaaacaccttaggattgggcaacgcagccggtctaggtgcagctttaagtcaggccgttagttccgtgggtgtcggagcttcttctgcgacctatgctaacgcagtatcgaatgctgttggtcagttcttggccggtcagggaattttaaatgcggcaaatgcagcatccctggctacttcctttgccaacgctgtgtcatcaagtgcattggcggccgtttcaagaatcagctcgccatcttacggtgcttttgcatctgttccaaaattcgttccaagtaacttgaatgcgggcggagtctccttcggagaacctttcgctgcattatcccaatccgtgccgacagacttacagagcgcccttgctccaattgcttcctcttctggactgggatcttccgctgcctcagccagagtgtctagtttagcgaatagtgtcgcatcagctatttcgtcgtcaggcggatctttgtctgtccctacattcctaaattttctttcctcagtaggagctcaagtttctagctcttcatctttaaattcgtcagaggttacgaacgaggtcttgttggaagcgattgccgctctgctccaagtgctcaacggagcccagataaccagcgtaaatttgagaaacgttccaaacgcccagcaggcacttgttcaagcactatcgggaggtacgtcttc

SEQ ID NO: 491 - DNA, 533 bp, Artificial Sequence
  Description of Artificial Sequence: Synthetic polynucleotide
gaagacttagcaggttctctagctagttcttttgctaacgctttatccaactcggctttgagtgtaggatctagagtaagttccccttcttatggagcattgagtccaatagctgctggtccaaactttatatcaactggactgaatgtcggaggtccatttacaaccttgagtcaaagtttgccaacctccctccagacagctttggctccaatcgtatcctcttccggacttggtagttcagcagctacagccagagttcgtagtttggctaatagtatcgctagtgctatcagttcttctggtggttctctgagcgtcccagcctttcttaacctactaagtagtgttggagcccaggtttcgtcatcttcctctcttaattccagtgaagttactaatgaagtactgctggaggctattgccgcactattgcaagtaatcaacggaggtagcattacgagtgttgacctcagaaacgttccaaacgcccaacaggatttggtcaatgctctatccggaggtacgtcttc

SEQ ID NO: 492 - DNA, 746 bp, Artificial Sequence
  Description of Artificial Sequence: Synthetic polynucleotide
gaagacttagcaggtaatgtcggataccaactgggttttaatgtcgctaatacgcttggaatcggaaacgctcctggtctaggaaatgccttatctcaggctgtatccagtgtaggagttggagcttcctcatcagcctatgccaacgctgtttctaatgcggttggtcaattcttagccggtcaaggagttctaaacgctggcaatgctggttcactagctagctcattcgccaacgcactgtctaactcagctctgtcagttggaagtagagttagcagtccatcttacggtgctctatccccaatcgcagctggtccaaatttcatttctacgggattaaatgttggtggtgcttcggttggtggaccgtttgactctcttagccaatccttgcctacctctttgcagactgcactggctcctatcgtctcctcttctggactgggatcaagtgccgctacagcaagggtatcatctctggcaaactccttcgccagcgcaataagctcctcaggtggctcattaagtgtgccaacattcttgaatctgctgagttccgtcggtgcccaagtatcaagttcttcatccctgtcgtcccttgaagtgactaacgaagttttattggaagcgatagccgcactactacaggttattaacggcggttctattaccagcgttgatcttagatacgtacctaacgctcaacaagacctggtaaacgcactctctggaggtacgtcttc

SEQ ID NO: 493 - DNA, 560 bp, Artificial Sequence
  Description of Artificial Sequence: Synthetic polynucleotide
gaagacttagcaggttccctagccagcagttttgcctcagccctgtccaactccgctctatcaattggatcaagggtcagttctcctagctacggagttttcagcccaatagccgccggtccaaatagcatctccacaggtttgaacgttggcggagcttctattggtggtccttttgctactttgtcacaaagtttaccgacttccctgcaaactgctttggctcctatagttagttcctcgggactaggatcttctgcagctactgcaagagtgagttcactcgctaatagtatcgcatcagccatctcctcatcaggtggatctctgagtgtgccaacctttttaaacctactgtcatctattggagcccaagtctcgagttcatcctcattgtcctcctcttctgaagtgactactcaggtcttattggaggctatcgcagctctactgcaggtgattaatggtgcccaaatcacttcagttaacttctccaatgtctccaacgtcaatagagcattggtagattctttggttggatccttcgcaggtacgtcttc

SEQ ID NO: 494 - DNA, 626 bp, Artificial Sequence
  Description of Artificial Sequence: Synthetic polynucleotide
gaagacttagcaggttcggcaacctcatccactaccaccaccacaactgtttcaaagtcggccgcggcggccgcagctgccgccgccgctgctagttcagcgagttcggcttccagagatagtgacagatcaagttccgccgctaaagcgtatgcctcttcctcagcaaatgcttcttcaaatttcgagaactaccagacctctgatctctctagaccctacgccacttcgagcaacgctcctgcatctacctcgggcatcaagaacgacttgtctcctttgatctcaggattgatctcctctagctctggtcttggctcttcagacgcctcagatagaatatcatacttattaacatccctactgtcagttataaactcagaaggtggtaggattgacttcgctgccgttgcgaatattcttgttagtctcgttagtgagatcagagccaagaattccgaactttcttactttcacattttgatcgaggcactgttcgaggtactcagcgccgtattacagatcatttcttcatctcatatagttataggaaacgcatcgttctccagcagctcaaacctggcattcgccgatgcatgtgcaaaggctttttcaggtacgtcttc

SEQ ID NO: 495 - DNA, 830 bp, Artificial Sequence
  Description of Artificial Sequence: Synthetic polynucleotide
gaagacttagcaggttcttttgcttctgctagcgcttacgctttcgcttttgccagtgcattttctcaggttctttccaactacggtctgctgaacataaacaatgcttattcattggcatctagcattgccaatgctgcctcaacttcagcttcctcagccgctgccgcagccgtagtagcatctagttcaagtgctgccaccgcagctggtgcagcatccacatctgtcccagcaacaagtttgtccagtgccactagagtcggtggttctttgtcctctgctgtttcacctgcctccgcaaggacggccacaggtgatggtacaacgtacttgccagtccagattcagccaggaatcggtttcgtcccaagtctgtctggagatattggaccaaacgtcccaggatccggaggatttggatcccccgctttacctagtccagtgtatggacctgcaatcctgggcccaggactcgttgcacctgccctggcaaatttgctaccacctttgtccgttcttcctagtgattctgccaacgaaaggatatcatcggttgtttcttctctgttgtcagccatttctagcaacggactggacgcatcctcattaggtggaacgattgcctccctcgtaagtcaaatctctgtttcaaatgccaaactttcatctagccaagtgttcttggaagccctactcgaagtgctttctggaatggtccagatcctcagctacgctgaggttggcgctgttaataccgataccgtaatctcaactagttcagctgttgctcaggccatatcgagcgcggtttccggaggtacgtcttc

SEQ ID NO: 496 - DNA, 683 bp, Artificial Sequence
  Description of Artificial Sequence: Synthetic polynucleotide
gaagacttagcaggtgcttctgcatcagcctacgcctcagcttttggctctgctattggacaatacttggcgggtatcggtatcatttcccaatccaatgcaagtgctctagctagttccttcgcatcagctatctcaagtgctgcgggctcactttcactgggtggtccattcggtgtatccggattgggtattggtggtttgccagttggagtctcgcctgtcggagtcgtcggtccagcaggagtctacggtccggcaggtctttacggacctggagtggtgggttccttaggaccagttacaccattgaacgtaatatatccttctttaacaacctcgattgccccaattattgtgggacctgccggactgagttcggcagcagctacttctagggcttcgtcccttgcttctagtgtcgcatcggccattagcagtgcaggatcggcaggtggtgtggatgtgggactgtttgcttctggattatcaagtctagtaagtcagattcagtcatctaatttaggtctgcagccggaccaggtgctgctagaggctttactggagggatactcggctctagcccaggttcttatttcaagccagatttcgtctgtttctgtctcatcatcatccgcactaggtccagcgttgttgaattacttggtcggaggtacgtcttc

SEQ ID NO: 497 - DNA, 560 bp, Artificial Sequence
  Description of Artificial Sequence: Synthetic polynucleotide
gaagacttagcaggtattctgacgcaggagaacgcctcttcacttgcgtcgtcagtagctaatgctctcagtgcttcatctctgttggttccatctgctataagcaccggtgtacctggactaattgttggtccgtctattgtatcctctttgaacgccccaatagcaggtttcgcagtcccgggcgtagcccaggtcattgtccccacagcctattccaccttactagcaccagtattatccccagccggattggcgtctacagctgctacttccagaatcaacgatattgctcagagcctttcatcgaccctctcaagcggatcacaattggcgcctgacaacgtcctacctggtctaatacaattgagcagttctattcagtcaggaaatcctgacttggatcctgctggagttctcattgaaagtttgttagagtacactagcgccttgcttgctctgctgcagaatgcccaaatcacaacatacgatgccgctacgttgccggcattcaacactgcactagtgaattatctcgtgccactcgtaggtacgtcttc

SEQ ID NO: 498 - DNA, 590 bp, Artificial Sequence
  Description of Artificial Sequence: Synthetic polynucleotide
gaagacttagcaggtgttttgaacgccgtcaacgcatcatcactgggttcggccctagccaacgcactgtcggactctgctgcaaactcagccgtaagtggaaactacttgggagtatctcagaatttcggaagaattgccccggtaaccggaggaacggccggaatttcagtgggtgtgcctggctatcttcgaacaccaagctcaactatccttgcccctagtaacgcccaaattatttcacttggtttacaaactaccttagctccagttctgtcgagttccggtttatcttcagcgtctgcatcggctagggtgtcctctcttgcccaatctctcgcctctgccttgagcacatccagaggtactttaagtttatcgacatttttgaatttattatcatccatttcgtctgagatcagagcttccacatctctggacggtactcaggcaaccgtagaagtgttgttggaagcactggctgcactactgcaagtgataaacggtgcccagattactgatgtcaacgtctcttcggttccaagcgtcaatgctgcgctcgtttccgcacttgtagcaggtacgtcttc

SEQ ID NO: 499 - DNA, 719 bp, Artificial Sequence
  Description of Artificial Sequence: Synthetic polynucleotide
gaagacttagcaggtatcgccagtgatacggcgctcgccggtgcactggctcaagctgtcgctggcgttggtgctggagcctctgcttctacatatgccaatgttattgccagggcggctggacagttccttgcaacccagggtgtcctaaatgccggcaacgcatccgcattgggatccgccctcgcaaacgctcttagtgacagtgcagccaactcagccgttagtggaaactatgtgggcgcctcccagaatttcggaagaatcgcacccgtcactggaggaactgccggtatatcggttggagttcctggtttcttaagaacaccagcttctaccattttagtcccttcaaatgctcagatcatctcacctagcttacagacaactctggcacctgttctctcttccagtggactgagttcggcctcagcgtcagcacgtgtcggatccctggcacagtccttggcatcggcactctcaacatcgagaggaactttgtcattgtctaccttcctgaacttgttatcaccgattagctcggagattagagcaaatacgtctttggatggcacgcaggcaaccgtggaagctttgttggaggctctagccgctcttttgcaagttataaatggagcccagattactgatgttaatgtttctagcgtaccatcggtaaacgctgcgttggctagtgctttggttgcaggtacgtcttc

SEQ ID NO: 500 - DNA, 653 bp, Artificial Sequence
  Description of Artificial Sequence: Synthetic polynucleotide
gaagacttagcaggtgccactgctgcttcctacggaaatgccttgtctacagccgccggacaattttttgctgcccaaggactactaaatgctggtaatgtatcgagtctggcttccgccttagcgaatgctctcagctatagcgctgctaattccgccgcttctggtaattacattggagtttcacaaaattttggtagcattgctccggtcgctggtacagctggtatctcagttggagtaccaggcctattgcccacatctgccggcacggtgctcgctccagcaaatgcgcaaattattgcgccaggcttacaaacaactctagcaccagtcttttcaagtagtggtttgtcatctgcctccgctaatgcaagagtctcctcactggcacagtcgtttgcttctgctttgagtgcttcacgcggaacgttgagtgtatctacttttctaaccttattatccccaatttcatcacaaattagagcaaacacaagtctagatggaactcaagcaactgtgcaagttttgcttgaggctctggccgccttgctccaagttattaatgcagctcagattaccgaagtcaatgtgagtaacgtatctagcgccaatgctgcgttggtttcagcactggctggaggtacgtcttc

SEQ ID NO: 501 - DNA, 605 bp, Artificial Sequence
  Description of Artificial Sequence: Synthetic polynucleotide
gaagacttagcaggtcaatttcttgccaatcagggcatcctgaacacaggtaatgctagttcactggcatcatcgtttagtaatgctttaagttcaagtgctgctaatagtgtcggatcaggattgttgctgggtccaagtcaatacgttggttctattgcacctagtattggtggtgctgccggtatctccatagctggacctggaatcctttcctacttgccaccagtttctccactgaatgctcagatcatatcgtcaggtcttttagcctcgctcgcaccggtgctgagttcttcaggtttggcttccagctcggctacctcaagggtcggttctctggctcaatcccttgccagtgcattacagtcgtccggcggaactctcgatgtatctactttcctgaatttgttatcaccaatttctacccagatacaagctaatacctcattgaatgcctctcaagccatagtccaagttttgttggaagccgtggcggcattattgcaaattatcaatggtgcacaaataacgtctgttaatttcggatcggttagttcagtaaacactgcattggccaccgcattggctggaggtacgtcttc

SEQ ID NO: 502 - DNA, 974 bp, Artificial Sequence
  Description of Artificial Sequence: Synthetic polynucleotide
gaagacttagcaggtagtcagtcagcttcacaggctgccgcatcatcgagtgcttctgccagcgcttctgcaagtgcattcgctcaatctgcttctctggcactggctagctctagctcattcgcctcagcaatttcctcagtctccagtgtaagttccctaggatctttgggctatcaggtaggtttgcaagcagccggcagtctgggcatcagtaactcgcaggctttcgcttcctctatctcacaagctcttacatcagtgggtgtcggagctagttccgccgcatacgcttccgcagttagtggtgtcgtcgcccaataccttagcggcaccggagtcctttcatccgccaatgcccaggctttggcctctagttttgccaacgtttttgctgctagcgctgcttctgcatcagctgcaacctccgcctcctcttctgcctcagctcagagcgcagcagcagcattaacgcagaaccaatccgctgcctctgctttcagccaggcagctagtcaagctggttcacaagccagttctcaagccggaagtcaagttgccagccaatctgctagtggtctgggtgctttcggttttggtactagtgcatctggcattataacgagctctccatctttggctaatctggtttcgaacgtcgctccgatactcctgtcctctaacggtttgagctcttcttcagcaagttcgagaataaattccattgcatcaggtctttcaactgccttatcgagctcgagaggcgtgtctctcgagaatttgtcctcatccttatcatctgtatttagcgagatccaaaacaattctttcggtgtctccgcagaacaagccttgatacaagcattgtttgaggtattaacaggtaccgtacaagtgcttaataggggtcagacatcgtttgtttccgtatcttcccctacagttataagctcatcgttctcaggtacgtcttc

SEQ ID NO: 503 - DNA, 680 bp, Artificial Sequence
  Description of Artificial Sequence: Synthetic polynucleotide
gaagacttagcaggtgctgccgctactgccggagcgggagcctccgtagcaggaggatatggcggcggtgcaggtgcagctgctggagcaggcgcaggtggatatggcggtggatatggtgctgtagctggttcaggcgctggtgcagccgccgccgcttcttcgggagctggtggtgccgctggatatggtcgtggctacggcgccggttctggtgctggagctggcgcaggtactgtagctgcatacggaggtgctggtggagttgccacctcatcatcttctgctaccgcctcaggtagcagaatcgttacctctggtggatacggttatggtacttcagctgcagcaggtgccggcgttgccgcaggaagttatgcaggcgctgtcaaccgattgagctctgctgaagctgcttctcgagtttcctccaatatagctgctattgcatccggtggagctagcgcactgccaagcgttatatctaacatctacagcggcgtcgttgctagtggtgtaagctctaatgaggccctgattcaagctttgcttgagttattatctgcattggttcacgtattatcgtcggcttcgatcggtaatgtatcttcagtaggtgtggactcaactctcaatgtagtgcaggacagtgttggacaatatgttggaggtacgtcttc

SEQ ID NO: 504 - DNA, 512 bp, Artificial Sequence
  Description of Artificial Sequence: Synthetic polynucleotide
gaagacttagcaggtgcttatggtggaggatatggaggaggagctgcagttggtcgtggtattacctacggttcagcaagcagttccgccacatcgtcctcaactgcaacttcttccggttctacggccttaactagtgctggatacggaagcggagttggtgtctcagctggagccggagccggcgcagccagcgctggaggttcttactctggatcagtttcaagactttcttccgcagaagcagtgtctcgtgtttcttccaatattggtgctattgcttccggtggtgccagtgcattaccgggagttattagtaatatcttctcgggtgtctccgcatccgctggctcctacgaagaggctgtcattcaaagtctattggaggtgttgtctgcgttactgcacatcctctccaacagctcaattggttacgttggagcggatggcctaacagacagcctagctgttgtgcagcaagctatgggtcctgtagttggaggtacgtcttc

SEQ ID NO: 505 - DNA, 419 bp, Artificial Sequence
  Description of Artificial Sequence: Synthetic polynucleotide
gaagacttagcaggtgcaggaagcggttctcagggagttggttctggatccaattatggtcaattctcttcacaggacgtctcaggtgctgtcttagcttccacgtctagattggcatcaggtcaggccacggaccgagttaaagatgttgtcagcaccttggtgtcaaacggcattaatggcgacgctttaagcaacgccatttcaaatgttatgacacaggttaacgctgctgtcccaggactttcgttttgtgagaggttgattcaagtgctacttgaaatcgtggctgccttggtacatatcttgtctagcagcaatgtcggatcaatcgactacggctccacatcaagaactgccattggagtttccaatgcattggcttccgctgtggcgggtgccttctcaggtacgtcttc

SEQ ID NO: 506 - DNA, 563 bp, Artificial Sequence
  Description of Artificial Sequence: Synthetic polynucleotide
gaagacttagcaggttcaggttcagcctcagtctctactggcggctacggacaaagccaagttgccagagcatcctcttcgagcgccgtaggaaccagctcttccgtctccacatctggcagctctggatatagccaggtcagtggtggatacggacagtcatccgccgtgggacaagcatctgctggttacggtcaaatgcagtcaggagttgctgtttccggtggttctgctagcgctacaatttcaagtgcagctagccgtttgagttctccaagctcttctagtagaatcagctccgcagcttcttcgctggctaccggaggtgtcttgaattccgctgccctaccaagtgtcgtcagtaatattatgtcccaagtttccgcttcaagtccgggtatgtcctcttctgaagtcgtgattcaagccttgttggaattagtgtctagtttgattcatatcttgtcctcagctaacataggacaagtagactttaacagtgtgggaaacaccgcagccgttgtgggtcagagtttaggcgccgccctaggaggtacgtcttc

SEQ ID NO: 507 - DNA, 461 bp, Artificial Sequence
  Description of Artificial Sequence: Synthetic polynucleotide
gaagacttagcaggttatggctcctcatcttcagtgagctccagttcctctgccgccagttctagcacatccggtgtcgtaacatcaggtggttacggctatggtgccggtgcagcagcaggagcgggagctggcgcaggtgcgtcagccggctcttattctggtgctgttaacaggctcagttcagctgaagctgcttcgagagtatcttccaacgtagctgctttggctagcggaggtccagcagccttagccaacgtcatgggtaatatttacagcggagtcgcttcttcaggagtttcttccggtgaggctttagtacaagctttgcttgaagtcatcagcgctctagtccacctgctgtccaatgcgtcaattggtaatgtctcttcggctggtctaggtaacacaatgagcctcgttcaaagcacggttggagcttatgctggaggtacgtcttc

SEQ ID NO: 508 - DNA, 473 bp, Artificial Sequence
  Description of Artificial Sequence: Synthetic polynucleotide
gaagacttagcaggtgctggtgcgggtgcaaccggcggatatggacggggagccggtgctggtgcaacgaacgcaggcggttatggtggtcaaggtggttacggagctggagccagagccttcgcaggtgcgggagtgggcgttggaacaaccgtagcaagtacaacttcaagattgtccactgccgaagcttcgtcacgtatctctacagctgcctccacgctagtttctggaggttacttgaacactgctgctctaccttctgttatcgcggatctttttgctcaagtcggagcttcctcgcctggagtgagcgattcagaagttttaattcaggttttgcttgagattgtctccagcctaattcacatcctatcttccagttccgttggacaagtcgatttcagttctgttggtagttctgctgcagcagtaggtcaatcaatgcaagtcgttatgggaggtacgtcttc

SEQ ID NO: 509 - DNA, 503 bp, Artificial Sequence
  Description of Artificial Sequence: Synthetic polynucleotide
gaagacttagcaggtgccggtgcaggacgcggaggttacggtcgcggagctggagcgggcggttatggtggacaaggaggctacggtgcaggtgctggagccggtgcggccgccgctgccggagctggtgccggtggttacggagataaagagatagcctgttggtcaagatgtcgctataccgttgcttctactacttctcgactttcttctgcagaagcttcgagcagaatttcttctgccgcatcgacattagtcagtggtggttaccttaacactgcagctttgccttccgttatctctgatttattcgcccaagtcggagcatcgtcaccaggagtatcagattccgaagttttgatccaggttctattggaaatcgtatcctccttgatacatattttatcctcatcttctgttggacaagttgacttcagctcggttggtagtagcgctgctgctgttggccaatcaatgcaagtagttatgggaggtacgtcttc

SEQ ID NO: 510 - DNA, 647 bp, Artificial Sequence
  Description of Artificial Sequence: Synthetic polynucleotide
gaagacttagcaggtgcaggagcaggaggcaccggaggatatggtcgaggttccggcgcaggtgctgctgctggagctgcagcaggagccggagccgcaggaggatacggaggttatggagcaggagcgggtgctggagctggtggagccagaggttacggaggaggagctggcgccggcgccggagctgctgcgggtggttatggcagaagggcgggtggatcgattgttggtacgggaattagtgcaatttcctcaggcaccggaagttcttattccgtctcctcaggtggttacgcttctgcaggcgtaggagtcggatccacggttgccagcacaacctcacgcttatcgtcagcccaagcctcaagtcgtatcagcgctgcagcctcgactcttatttccggtggttaccttaacactagtgcccttccttccgtcatttccgatttatttgcccaagtatccgcaagctctcctggtgtatctgactccgaagttctaattcaggtcctgcttgagatcgtaagctccctgatccatattctgtcgtcgagctcagtcggacaagtagacttcaactccgtcggatcttcagctgctgccgtcggacagtctatgcaggttgtcatgggaggtacgtcttc

SEQ ID NO: 511 - DNA, 674 bp, Artificial Sequence
  Description of Artificial Sequence: Synthetic polynucleotide
gaagacttagcaggtgcaggagctggtggtggctacggaggaggttactctgcaggcggaggtgccggtgctggcagtggagctgctgcaggtgctggcgccggaagaggtggagctggcggctattccgctggagctggtacaggtgctggtgctgccgctggtgctggtacagctggtggatattcaggaggttacggtgctggcgcttcaagctcagctggttcttcctttatctctagttcgtccatgtctagttcccaagccactggttactcttcctctagcggctatggtggtggtgccgcgtctgccgcagctggagccggtgcagctgctggtggatatggtggtggttatggtgctggagccggcgctggtgccgcagctgcatctggcgctacaggtagggttgccaattctttaggtgcaatggccagtggaggtattaatgcattacctggagtgttttcaaatatctttagtcaagtttctgctgcctctggaggtgcatctggtggtgcagtattggtccaagcactaacagaagttatcgcattattgttacatattttatccagtgcttccattggaaacgtgtctagccaaggactggaaggatccatggccatagctcaacaagcaatcggagcgtacgctggaggtacgtcttc

SEQ ID NO: 512 - DNA, 587 bp, Artificial Sequence
  Description of Artificial Sequence: Synthetic polynucleotide
gaagacttagcaggtgctgcctcttcccaagtcgtgtctaggaccactactacaacctcacaaagcgctgccggcggagctgcctctggttactctactggtgtaggaagtggtgctgccgcagccacctccggtgcaggttacggaggacaacgaggatacggtaccggagccggagccgcagctggagcagccgcttctggtacaggtgctggttacggtggacaagcaggctacggtcaaggtgcaggcgcatccgcagcagctgcagcctcagcggcatctaatagaattgttagtgccccagcggtgaacagaatgtctgctgcatcgtccactcttgtttccaatggcgcttttaatgtaggtgctttgggatcgaccatttccgatatggccgcccagattcaggctggaagtcagggtttgtctagcgctgaagctactgttcaagccctactcgaggtaattagcgtactgacacacatgttgtcaagcgccaatataggatatgttgatttcagtagagtcggtgatagcgctagtgctgtttcccaatcaatggcctacgccggaggtacgtcttc

SEQ ID NO: 513 - DNA, 518 bp, Artificial Sequence
  Description of Artificial Sequence: Synthetic polynucleotide
gaagacttagcaggtggcccgggtggtccaggaggacctagaggagcttatgttccaggtgctggtggtttttccggcgtttcctcgggtgcgggtggtgtcagaggaggttccgtaatgccctccggtggatccggatctgcaggtccagtcactatcgtcgagaatattacagtaggtggaggtccatcgggaggttcgggtggagctgccggcggacaaacctaccaaacttatggtggtagtagcagactcccctctctagtcaatggattgatgggatccatgcaacctacgggatttaactaccaaaacttcggtaacgttctttctcaatatgctaccggatcgggtacatgtaattccaatgatgtaaatctgttgatggatgccctcatggctgctctacactgtttaagctacggatcaggttctgttccgtcaaccccgacttattctgccatgtcagcctacaaccaatctataagaaggatgttcacatactcaggtacgtcttc

SEQ ID NO: 514 - DNA, 671 bp, Artificial Sequence
  Description of Artificial Sequence: Synthetic polynucleotide
gaagacttagcaggtggagctggtggaccaggagcaggtggtgttggtccaggcggcgtaggcccaggtggagtgggacccggaggtatttatggaccaggtggagcaggtggcttgtacggtccaggtgcgggaggagccttcggatctggaggcggtgctggtgcacctggaggtccaggtggtcctggcggcccgggaggacctggtggtttgggcggaggcgttggcggtgccggcactggtggaggtgtcggaccaggagtcggcggtgttggacctagtggaggagctggaggaacaggtccagtgtcggtgtcgtctaccattacagttggtggaggacagtcgtccggtggagttttgccctctactagttacgccccgacaacatcaggatacgagagactacccaaccttattaatggtatcaaatcttcgatgcagggcggaggattcaactatcagaatttcggtaatattttgtcacagtatgcaactggatctggtacatgtaattactacgacattaatcttttaatggatgctctcttagctgcactacatactcttaactaccagggtgcatcgtatgttccttcttatccatctccatccgaaatgctatcatatactgaaaacgtaagaagatacttctcaggtacgtcttc

SEQ ID NO: 515 - DNA, 521 bp, Artificial Sequence
  Description of Artificial Sequence: Synthetic polynucleotide
gaagacttagcaggtggttatggcccaggcggatccggatcaggtggtgtaggcccgggtggttatggacctggtggatcgggtggtttctatggacccggaggaagtgaaggaccctatggtccttcaggcacctacggatctggaggtggatacggccctggaggagctggaggtccatatggaccaggatctccaggtggagcttatggtccaggttcgccaggaggagcttattacccttcctctcgagtccctgatatggtaaacggcattatgagtgccatgcaaggtagtggttttaattaccaaatgtttggaaatatgctttcgcaatatagttccggctctggaacttgtaacccaaataatgtaaatgtgctaatggatgctttattggcagctctgcattgtttatccaaccacggcagctcaagcttcgccccaagtccaactccagctgcaatgtctgcatacagtaatagtgttggacgtatgttcgcatactcaggtacgtcttc

SEQ ID NO: 516 - DNA, 506 bp, Artificial Sequence
  Description of Artificial Sequence: Synthetic polynucleotide
gaagacttagcaggtgccggaggatcaggcccaggaggtgccggtcccggaggagctggtccaggtggtgctggacctggaggtgctggtcctggtggagtgggtccaggcggagctggcggaccatatggtagcggaggattcggcttcggaggagccggtggtagtggaggaccttatgtcccaggaggcgcttatggagctggatctggtaccccttcgtattctggctcaagagttcctgacttagttaacggcattatgagatctatgcaaggcagtggatttaactatcagatgtttggtaatatgttgagcaagtacgcctcaggatcaggtgcttgcaattcaaacgatgttaatgtcctaatggatgcattactggctgctttgcactgtctctcatctcatggatcaccgtctttcggctcctctcccactccaagcgccatgaacgcctattcgaattctgtgagaagaatgttccaattttcaggtacgtcttc

SEQ ID NO: 517 - DNA, 647 bp, Artificial Sequence
  Description of Artificial Sequence: Synthetic polynucleotide
gaagacttagcaggtggttctggaccaggaggtgccggaggcagcggtcctggaggtgcaggaccgggtggtgtgggtccaggtggatccggaccgggaggtcttggatcaggaggttccggaccaggtggtgtaggtccgggaggttctggtccaggcggagtcggacctggtggttatggacctggaggatcaggaggattatatggacccggatcttacggaccaggcggttctggtgtcccttacggatcttctggaacttatggatccggtggtggttacggacctggaggtgctggtggagcttacggaccgggttcgcctggaggtgcatacggccctggatcaggaggctcctattacccttccagcagagtaccagacatggttaacggtatcatgtccgctatgcaaggatccggattcaattatcagatgttcggaaacatgttgtcacaatactcctcaggttccggaagctgtaatcctaataatgttaacgtactaatggatgctcttttggctgctcttcattgcctgtctaatcacggttcctccagttttgccccatctccaaccccagccgccatgtctgcgtacagtaactctgttggtcgaatgtttgcatactcaggtacgtcttc

SEQ ID NO: 518 - DNA, 539 bp, Artificial Sequence
  Description of Artificial Sequence: Synthetic polynucleotide
gaagacttagcaggtataaacgttgattcagacattggctctgtttccagcttgattttgtccggaagtacattgcagatgaccgcatctggtaaaggttcctaccctggaggagaaagtagtcaattcagtggtttggactctaatatcggcctggttggtacacaggatgttgctataggcgtgagtcaacctgtggatatctctttaaacaatatcctggactcccctcaaggattaaaaagtccacaagcatcttcgcgcattaaccgattatcctcctcggtggttaatgccttaggtcctaacggtctagacattaataactttagcgacggtttgcgcactactctgtcacagttgtcatctagcggactgagtaaaaaggaggctgctatcgaaactttaatggaagccatggttgcccttctgcaagtgcttaactctgcacaggtgaatcaggttgatacaagcagcacagtagttacctctagcagcttggctaaggccctgtcctccttgttttcaggtacgtcttc

SEQ ID NO: 519 - DNA, 533 bp, Artificial Sequence
  Description of Artificial Sequence: Synthetic polynucleotide
gaagacttagcaggtggcggagttggatctttcggaggacaaacttcatttggtcaaacctcgggtttgacttcctcagctgcttcgcaatctgacttcactcaagcctcaggatttgtgagttcggcaacaagccaaggcgcgtttggtcagacatccggtatcgcctcttttggcgctggaccaagtacaggacttagtgttagaagcacgttaaactcccctaatggtttgagaagcggttctgccgctgcgagaatctctcaactgacttccagcgtaaggaacgcgataggcccgaacggagtggatgctaacgcactggctagatctctacaggcttcgtttagtagtcttagatcttcaggaatgagttcaagtgatgccaagattgaagttttgttcgaaactatagtcggtctattacaacttttaagcaatacccaaattcgtggagttaatatggctactgctagctcagtggccaacagcgcagcccgatcatttgagcttgttcttgcaggtacgtcttc

SEQ ID NO: 520 - DNA, 500 bp, Artificial Sequence
  Description of Artificial Sequence: Synthetic polynucleotide
gaagacttagcaggtgctggatatacaggacctagtggtccatcaacaggtccaagtggataccctggaccactctcaggaggagcatcgtttggttctggacaatcaagttttggtcagacttcagcattctctgcttcgggagcaggccaatcggctggagttagtgtaatttcctcactcaactctcctgtgggcctgagatccgcttcagctgcttcaagactttcacaactgaccagcagtatcactaacgccgtcggtgcaaatggtgtcgatgccaacagcttagccagatctcttcaatccagcttttccgctttgcgatcgtctggtatgtctagttcagacgctaaaatcgaggttttattagagactatagttggtttgttacagttgttatcaaacactcaagtcagaggagtaaatcccgctactgcatcttcagttgcaaacagtgccgctagatcctttgaacttgttttagcaggtacgtcttc

SEQ ID NO: 521 - DNA, 500 bp, Artificial Sequence
  Description of Artificial Sequence: Synthetic polynucleotide
gaagacttagcaggttttgcaagagcatataccggtccacaaatatctcaacctgcaccacttggagtgggcccacaagtttcccaaccaaggccactaggtgtagcccctcaaacctccggtgcacgaccatttggaggtgtcactggtccttctgcaggaataagtttgggttccgcattgaatagtcctatcggtcttagatccggtctagcagcagccagaatctcacagctaacaagttctttgggaaacgcaatcacaccttacggtgtggatgctaatgctttagcatcttctttacaagcttcattttcaacattacagtcctcgggtatgtctgcctcagacgccaagattgaggttctgctggaaactattgtcggtttactacagttgttgtccaacacccaaattaggggagttaacatggcgaccgctagctcggttgcttcgtctgcagctaagagtttcgagttagtactttcaggtacgtcttc

SEQ ID NO: 522 - DNA, 662 bp, Artificial Sequence
  Description of Artificial Sequence: Synthetic polynucleotide
gaagacttagcaggtgcctctgctgcagatattgccactgcaatcgctgcttctgtcgccactagcctactttcctcgggttatctatcagattcaaatgcttctcaactcggtaattctctggcatcctctatctcttcagttgcattgaacgttgctgctgacttgggtgtctctttaagcgcaagtgcaaatttgtcgagctcacttggtgctagtgcaggtatatcctcctcattcgacgctagttccgcttcttccacatctctatcttcgtcgtcatctctctcttcgcaacaacaagtgacatcaagtgcagctgtatccttaaactccgttataactagtcctgtaggattggcgtccccacaggcctcgtctagagtcaggtatctgtcacaattggctttgaacgctatatcaccgcagggattcaatgtcgaagctttcgtatctcaattgggaacaatcatggcccaagctagagcaatgggtatgtcggcttctgacgctacgatagaaactttactcgaaggtttgcttagcctggtccaagcgttaggctcctgtcaggcaggtagttataatccagcaagatccgcggaagcctcaaacattttcctcagtgctattcagtctacgttgagttcaggtacgtcttc

SEQ ID NO: 523 - DNA, 488 bp, Artificial Sequence
  Description of Artificial Sequence: Synthetic polynucleotide
gaagacttagcaggtccaggatacggttatgcagcctattacgcaagttcatatggttacggacctggagttggatctggagcgggagctggatccggttcaggcgctggcagtgcagccggtgccggcagtggtagcggagccggcgcaggtcgagacgtgaccaatactgttgttaactctgtctctagattgtcgtccccttctagttccagcagagtttcatccgcagtttccggattgttaccaaacggaaacttcaacttgggtaacttaccaggtattgtttctaacttgtcctcctctattgcgtcctcaggtttatctggttgcgaaaatcttgtacaagttcttatcgaggtcgtcagcgcactggttcacattctaggttcggctaacatcggtaatattaatatgaatgctgcttccagtactgcagccgccgtaggccaagccattgtcaatggattgtattcaggtacgtcttc

SEQ ID NO: 524 - DNA, 731 bp, Artificial Sequence
  Description of Artificial Sequence: Synthetic polynucleotide
gaagacttagcaggtaaagcgatttcctcttctgcagcatccgcagctgcatctgcgtcggctgcttcagctgccgctacagcctcggctgcagcaagctcaagcgcttcaactacaagaacaactggagcaacgtcggcagccggtgatttctcagttgtggccgacgccagcgcagattcctcagtcttagctgatgaagctgctagaggagccgtcggtgccgtgtccggaggcggagccgcctcccgctcggtaggtttgattggatctggtttcccgggatatgtttcttctgctccattctcactcatttcttcagtggcaggtggtggtggaagttctccagtgcctgtctcaccactcgccggaggtttgctaccaccatcaagttatctgtcctccccagcagccgctgagagaattagttcagtgattccacttctattatcaggtattagtccaaatagattagatgcctcgttgcttggcaacactctgggtagcttggtcgcacaagtttctttgaatcgtgcaggattgtcattttcacaaatcattgtagaagcactattggaattgttgtgtggcgttatccagatcttaagtttcgccgaaattactgtagttaacacaggtacattatcgtcaaccagttttgccttggctcaagctatgtctgccgctgtgagaaatacctaccgtttccactcaactgtaggtacgtcttc

SEQ ID NO: 525 - DNA, 509 bp, Artificial Sequence
  Description of Artificial Sequence: Synthetic polynucleotide
gaagacttagcaggtggatacggaccaggcagcggacagcaaggacctggtcaacaaggtccaggtcaacagggccctggtcagcaaggtccctacggagccggtgcttcagctgctgcagccgcagctggaggatacggtccaggtagcggacaacagggtccaggtgtgagagtagcagcccctgtggctagtgccgctgcttcccgtctcagttctagcgccgcatcttcaagggtttcttcggcagtctcttcacttgtttcttcaggaccaacaactccagctgctttatccaatacaatatcttcagctgttagccagatttctgcatcaaatcctggactaagcggttgtgacgtgttggttcaagctttgttagaggtcgtttctgctttggttcatatccttggatcttcaagtgtcggtcaaatcaattacggagcatcagcacagtatgcacagatggtgggtcagagcgtaacacaagccttggtaggtacgtcttc

SEQ ID NO: 526 - DNA, 446 bp, Artificial Sequence
  Description of Artificial Sequence: Synthetic polynucleotide
gaagacttagcaggtggagccggaggtgctggtcaaggtggtttaggcgctggtggagctggacagggcggttacggcggaggagcctatggaggtcaaggagcagcttcctctgctgctgcagcctctgcagccgctagccgtctctcttcgccttctgccgcaagtagagtctcaagtgcggtttcttcattagttagctccggcggaccaagttcaccagctgccctgtcctcgactatctctaatgtagtctctcagatttcagcttccaatccaggattgtcaggctgtgatgtactagttcaagcattgctggagattgtctcagctctagtccacattctgggaagtgctaacattggtcaagtaaactcgtccgctgcaggacaaagtgcgagtctagtcggacaatctgtctaccaggccctgtcaggtacgtcttc

SEQ ID NO: 527 - DNA, 482 bp, Artificial Sequence
  Description of Artificial Sequence: Synthetic polynucleotide
gaagacttagcaggtggttatggaccgggagcaggtcagcaaggaccaggaggtgcgggacaacaaggcccgggaggtcaaggaccttatggaccatctgttgccgcggccgcgtccgctgccggcggatatggacctggtgcaggtcaacaaggtccagtagcatctgctgcagtctctaggttatcttcgccacaagcttcttcgagagtttcctcggctgtttcaagtctagtctcttcaggtccaacaaatcctgctgctttgtctaatgctatgtcctcagttgtctcacaagtttcggcctctaatcctggcttgagtggttgtgacgtactcgtacaagcactattagaaattgtgagtgccctggtccacattctgggttcatcttctataggccaaataaactatgctgcttcttcccaatacgcccaaatggtcggtcaatctgtggctcaagcattggcaggtacgtcttc

SEQ ID NO: 528 - DNA, 521 bp, Artificial Sequence
  Description of Artificial Sequence: Synthetic polynucleotide
gaagacttagcaggtggctacggaccaggagccggtcaacaaggcccaggaggtgctggacagcaaggtcctggttcccagggtccaggtggcgctggccagcagggtcctggtggacaaggaccatatggtccctctgcagcagccgccgcaagtgccgccggaggatatggtccaggtgctggtcagcaaggccctgtcgcctcagcagctgcatctagactttcatcccctcaagcatcaagtcgtatttcatcggccgtctcttcactggtttcttcaggtccaactaatcctgctgctctttctaatgccatctctagcatcgtatcgcaggtatcagcttcgaatccaggattatcaggttgtgatgctttagtacaggctttgttagaaatcgtatctgctcttgtacatatcctaggttcttcaagcataggtcaaataaactatgctgcttcaagtcagtacgctcaaatggtcggtcaatctgttacacaagctctagtaggtacgtcttc

SEQ ID NO: 529 - DNA, 470 bp, Artificial Sequence
  Description of Artificial Sequence: Synthetic polynucleotide
gaagacttagcaggtggatacggaccaagatatggtcagcaaggtccaggagctggtccatatggaccaggtgctggagctaccgcggctgcagcaggtggttacggaccgggagctggacaacagggtcctagatctcaagcaccagtcgcctcagcagctgctgctcgtttaagctcgccacaggcaggtagtagggttagcagtgccgttagtactttagtctcttctggacctaccaatccggctagtttgtcaaacgctatcggttcagttgtatctcaggtcagtgctagtaacccaggattaccaagttgtgatgttttggtgcaagctctcttggaaattgtttctgctttggtacacatcttgggcagcagctcaataggacaaattaactactctgctagttcccaatacgcgaggttggtcggtcagtccattgcccaagccttgggaggtacgtcttc

SEQ ID NO: 530 - DNA, 443 bp, Artificial Sequence
  Description of Artificial Sequence: Synthetic polynucleotide
gaagacttagcaggtggtcaaggaggctatggaggtttgggaagtcaaggtgctggacagggcggatacggtggcggtgcttatggaggccagcaaggtgcagctgcctccgccgcagctgcatcagccgctgccagtagattgtcgtcccctggagccgctagccgagtctcatctgcagtgacttcattggtatcatcaggaggtccaacgaactcagctgctttgtccaacactatatccgacgttgtttcccagatatcagctagtaatccaggattatccggctgtgacgtgttagtccaagcacttttggagatcgtttcagctctggttcacattctgggaagtgcaaatataggtcaagtcaactccagttccgccggtcaatctgccagcttagtgggtcagtctgtataccaagcattatcaggtacgtcttc

SEQ ID NO: 531 - DNA, 386 bp, Artificial Sequence
  Description of Artificial Sequence: Synthetic polynucleotide
gaagacttagcaggtggttacggaccaggtgcaggtcaacaaggacctggatcacaagctcccgttgcatcggcagcggcttccagattatcttcaccgcaagcttctagtagagtttcttcggccgttagtacattggtgtccagtggtcccaccaacccagctgccctgtctaatgcaatctcttctgtcgtgtctcaagtttcagcctctaacccaggactctcaggctgtgacgttttagtccaagctctacttgagctcgtcagtgccttggtgcatatcctgggaagtagttctataggacaaataaattatgccgccagcagccaatacgctcagatggttggaaactcagttgctcaggcattgggaggtacgtcttc

SEQ ID NO: 532 - DNA, 512 bp, Artificial Sequence
  Description of Artificial Sequence: Synthetic polynucleotide
gaagacttagcaggtggatatggaccaggtgctggtcaacaaggtcctggtagccaaggtccaggctccggtggccagcaaggacctggtggtcaaggaccatatggtccatcagccgccgccgcagcagctgctgccggtggatacggtccaggagcaggacagcaaggtccatcttcacaagccccagtagcttcagctgcagccagtcgattgtctagtccacaggcctctgctagagtaagtagcgctgtaagtaccctcgtgtctagcggtccaacatcccctgccgctctctctaatgccatttcttctgttgtctctcaagtctcagcaagcaatcctggtcttagtggttgtgatgttttagttcaggctctcctggaaattgtgtctgctttggtgcacatattgggtagttcgtccataggtcagataaactacgcagctagtagtcaatacgctcaaatggttggtaactccgttgcgcaagccttaggaggtacgtcttc

SEQ ID NO: 533 - DNA, 536 bp, Artificial Sequence
  Description of Artificial Sequence: Synthetic polynucleotide
gaagacttagcaggtggccaaggaggtagaggtggatttggaggtttgtcctcacaaggcgctggaggtgctggtcaaggaggatctggtgccgctgcagccgctgccgccgccggtggagatggtggatctggattaggtgattatggagccggcagaggttacggtgccggcctcggtggagcaggtggtgcaggcgtggccagtgcagctgcttctgctgccgccagtagactgtcatccccaagtgcagctagcagagtcagttctgctgtcacttctttgatatctggtggaggccctactaatccagctgctttatccaacactttcagcaacgtcgtttaccaaatctctgtgtctagtcctggattaagtggttgcgacgttttaatacaggctctactggaacttgtatccgctttggttcatattctcggttcggcaatcattggacaagttaattcctctgcagctggtgaatctgcgagccttgtcggtcaaagtgtataccaggctttttcaggtacgtcttc

SEQ ID NO: 534 - DNA, 554 bp, Artificial Sequence
  Description of Artificial Sequence: Synthetic polynucleotide
gaagacttagcaggtggacagggaggccaaggtggctatggcggcttaggatcccagggagccggacagggtggttacggccagggtggagccgctgccgcggctgcgtccgccggaggtcagggtggccaaggtggttacggtggattaggctcccaaggtgctggacaaggtggatacggcggtggagcattttccggtcaacaaggtggtgcagcttctgttgctacggcatctgccgctgcatccagactttcctctcctggagccgcctccagagtcagttctgcagttactagtcttgtttcaagtggaggcccaacaaactctgccgcattatccaatacaattagcaacgttgtaagccaaatttcctcaagcaatccgggtctgtctggatgcgacgtactcgtccaagcacttttggaaattgtctctgcactggtgcacattctaggctccgccaatattggtcaagttaacagttccggagttggtaggtcagcatccattgtgggacaatcgattaatcaagccttttcaggtacgtcttc

SEQ ID NO: 535 - DNA, 389 bp, Artificial Sequence
  Description of Artificial Sequence: Synthetic polynucleotide
gaagacttagcaggtccaggatatggaccaggcgcaggacaacagggcccaggatctcaagcacctgttgcttctgccgctgccagtaggttatcgagcccacaggcttcatccagagtgtctagtgccgtttctacacttgtctcatcgggtcctacaaatccagcatctctctctaacgcaatttccagcgttgtgagtcaagtctcttctagcaatcctggattgagtggttgcgacgtcttagtgcaagcacttcttgaaatcgtctcagcattggtgcatattctgggttccagttcaatcggtcaaataaactatgctgcttcctcccagtatgcacagttggttggccaatcccttactcaagctttgggaggtacgtcttc

SEQ ID NO: 536 - DNA, 683 bp, Artificial Sequence
  Description of Artificial Sequence: Synthetic polynucleotide
gaagacttagcaggtgccgcttctagtgctgctgtgggcgcagctgctacctcgggtgccgccacctctggagctgcaactagcagttcaagtgcgactggcgttggtggatccgtttcttccggagcatctccagcctctgcaggaaccgcaactggaggaggaatttctttcctacctgttcaaactcaaagaggcttcggactagtcccgtcgccaagtggtaacattggagccaatttcccaggatcaggtgaattcggcccttccccattgacttcaccagtttacggaccaggtatcttgggaccaggactggttgttccatcattgcaaggtttgctaccaccattgtttgttttgccttcaaattcagctacggagcgaattagtagtatggtatcaagccttttgtcagcagtctcttctaacggactggatgccagctcctttggtgacactattgcttctttggtttcccagatatccgtcaataactctgatttgtcctcgagtcaggttttgttggaggcactactggaaatattatcaggtatggttcaaatactttcgtacgccgaagtgggaaccgtgaatactaagactgtatccagtaccagcgcagcggtggcccaggctatttccagcgctttttccggaaatcaaaattcaggtacgtcttc

SEQ ID NO: 537 - DNA, 572 bp, Artificial Sequence
  Description of Artificial Sequence: Synthetic polynucleotide
gaagacttagcaggttctggcgcagcaagagctgctcagacagcttccgctgcaagtgcagcctctgccagctcaagcttggctcagttgggaagtgccctagcacaatcttcttctttcgctgcagctttcgaccagggtaattccgccgctagtgccgctgctatagcttacgtccttgctcagagtgccgcaaacaaggtgggtttgagttcttatagtgcggctataagcaatgctgcctccgctgcagtcgaatctgttggtggttatgcatccgctagcgctcatgcttttgctttcgcttcggccgtttcacaggttctgtctaactatggattgataaacttgtctaatgctttgtccttggcaagttccatagctaacgctgttagcgcttctgctagttcagctgcagccgtgtctagtgctgcagcagctacaggtgctacctctagtgcagcagtcggagcagccgctacctgtggtgctgcaacatctgcatcaagtgccacgggagttggagaaacagtagcatgtgcaactagcccagcctcaacaggtacgtcttc

SEQ ID NO: 538 - DNA, 578 bp, Artificial Sequence
  Description of Artificial Sequence: Synthetic polynucleotide
gaagacttagcaggtactgcagctggtggtggaatttctagcttacctgtacaaactcagcctggattcggtttcttgttgtctccttctggaaacattggcccatccgttagcggcagcggtggttttggaccttccccattaccatctcctgcctctgatggctttagtccgtccccactcccatcccaagtttatggaccaggaatattgggacctggtttagtagccccttcgctcgaaggtctgttgccaccactgagtatcctaccttctgattcagctaatgagcgtatcagctccgttgtcagttctctcttggctgctgtatctagcaacggtttggatgcaagttcactaggtgataatctcgcaagcttggtttcccagatcagtgctaacaatgctgacctgtccagtagccaagttatggtggaggccttgttggaagtcctaagcggtatagttcagatcttgagctatgccgaagttggtgccgtgaatacagaaaccgtttcgtcaacaagttccgcagttgcccaggcaatatcatctgctgttttaggaggtacgtcttc

SEQ ID NO: 539 - DNA, 551 bp, Artificial Sequence
  Description of Artificial Sequence: Synthetic polynucleotide
gaagacttagcaggtagtggaggatatggttcacaaggagcaggccaaggaggccaacagggtcgtggtcaaggtggtcaaggtcaatatggcccaggagagggcgagcaggttccaggccaaggaggtcaaggtccagcagcttctgccgctactgcttcagcaggaggacccggtgaatacggaggtcagcaaggccctggacaaggtggacaacaacaaccaggtcaaggcggacaaggcccatctgctgctgccgctgcctctgctgctgtaggtagcggaggatacggttctcaaggtcaacagggacaaggaggacagggacctactgcttccgcagctgctgctgcagcttctgttgctggtccaggtggttacggcgcttccggacaacagggtcctcgtcaaggatcgcaacaaggaagattcggaccagcagctggacaacaaggaccaggacagacgggacaaatgggcccaggtcagcaaggtccaagcggaccgtcatcggctgccgccgcttccgctgcagccgcaggtacgtcttc

SEQ ID NO: 540 - DNA, 452 bp, Artificial Sequence
  Description of Artificial Sequence: Synthetic polynucleotide
gaagacttagcaggtggtccgggcggatacggtggtccaggtcaacaaggtggtggccaacaagccccggtccaaccgcgaccatacgttccaggaatgtcaggtcagatagtgacatcagacgtttcatcaaccgtatccagcgccgtttctagaatgtctactccaggctctggttcgagaatttctaatgcagtgtctaatattcttagttccggagtatcgtcaagtagtggcttaagtaatgtcatcagtaatttgtcctcttcaatttccacatccaatcctggactatctggttgcgacgttctggtacaagttttactggaagttataagtgctctagtacacatcctgagttccgcttctttaggtcaagtgggatcttctccacagaatgcacagatggtcgctgccaacgctgtggcgaacgcattttcaggtacgtcttc

SEQ ID NO: 541 - DNA, 449 bp, Artificial Sequence
  Description of Artificial Sequence: Synthetic polynucleotide
gaagacttagcaggtccaggaggctatggaggtcctggtcagcagggtggtggacaacaagcaccagtacagccaagaccatatgttcctgttacaagtggtcaaattgtgacaagtgacgtaagttccacagtttcatcggccgtttccagaatgtcaacccctggatccggatctagaattagcaacgccgtctccaacattttgtcctcaggagtctcatccagttccggattatccaacgctattagtaacattagttccagtatctcggcatctaatcctggactatcgggatgtgatgttcttgttcaagttcttttagaggtaatttcagcactggtacatatattgggctcagcatcagttggtcaggtgggttcatctccacaaaatgcacagatggtcgcagcaaacgctgttgccaatgctttctcaggtacgtcttc

SEQ ID NO: 542 - DNA, 617 bp, Artificial Sequence
  Description of Artificial Sequence: Synthetic polynucleotide
gaagacttagcaggtgctggtggtgactctggcctattcttatctagtggagactttggccgcggcggtgcaggagccggagctggtgctgcagccgcttcagctgcagcagctagtgctgcatcggccggtgccggcagaggtacaggttttggagaaagaatactaataggcggttcaagaggattcggtggcgccagggttgatgctcctgcagcatcaactgcttctgcaagtgctgcggctgcgtcctctggcgctggtggcggctctaggtttggtggattaggagtgggagtatttggtgccggatcgggtgaactgagtgttgcttcacgcataagcactatggcttcttctatgtcatcactgttatcctcgaatttctcaccagttattttttcctctcttgctaacgtaattgcaaatggtgcttctgctatagcagtcgctcatccagaattatctggtgcaggcgtgttaacagaagcattactggaagcattggtggccttctgctacgcacatgcgggatcaatcgcctccgcttctgatgtcaacttagcagtgacaacactcgcatctaccatgcaaggttccctgccaggtacgtcttc

SEQ ID NO: 543 - DNA, 434 bp, Artificial Sequence
  Description of Artificial Sequence: Synthetic polynucleotide
gaagacttagcaggttctggacagggtgcgtctttcggaatatcccaacaatttggagctcctagtggagctgcttcctccgcagctgcagctgccgctgccgcggccggagctagctccccaggtgccttgctggtttctgccgatgcaccatccagaatagctagtgtgtcatcatctttaaactccgtcgtctcttctggcgcttctgcatcttctttcgcctccattgcgacccaaatcgctgatgttgcaggtcaagtgtctagtgttcaccctgagctctcatccttggaagtactcgtagaagctctgatcgaaatcattgttgcactagtgcacgcacagtcaggaggagcgtcaagtgcaagtgcgtccgcttcagcatcagctctggccagccaactaggacagcttttcggaggtacgtcttc

SEQ ID NO: 544 - DNA, 527 bp, Artificial Sequence
  Description of Artificial Sequence: Synthetic polynucleotide
gaagacttagcaggtggagctggagccggtcagggtggttacggaggacaaggaggattgggtggttatggacaaggagcgggtgcaggagcaagcgctgcggcttctgcttccggtgctggtagtggtcaaggaggatatggaggacagggtggatacggtcagggaacaggtgcaggtgctgcttcaagcgctggtgtcgcagtaactgttggaaacactgtctctagactatcatccccacaagcggcttctcgtgtttcctcagctgtttcatccttagtatccaacggacaagtcaatgtcgcagcattaccaagtataatttcctctctgtcgtccagcatatctgcttcgtcgactgccgcaagtgactgcgaagtgctggtgcaagttttgctggagattgtctccgctcttgttcagattgtctcaagtgccaatgtcggttacataaatcctgaggcatctggatctctcaacgcagtcggctccgccttagctgctgctatgggaggtacgtcttc

SEQ ID NO: 545 - DNA, 518 bp, Artificial Sequence
  Description of Artificial Sequence: Synthetic polynucleotide
gaagacttagcaggtcagggcggtcagggaggttacggacgacagtctcaaggagccggatcggctgcggctgccgcggcagccgcagcagcagctgccgctgcaggaagcggtcaaggcggatatggtggccagggacaaggaggatatggtcaatcttccgcttctgcctcagcagcagcctcggcagcctcgaccgtagccaattcagtctctaggctgtctagcccatcggccgtctccagggtttctagtgctgttagctctttggtatcaaacggccaagttaacatggcggctttacctaacattatatctaatattagctcatctgtctctgcttccgctccgggtgcttcaggctgtgaagtgattgtacaggctttacttgaagtaattactgcactagttcaaattgtctcatcgagttcagttggatatattaacccatcagcagtgaatcagattaccaatgtcgtggctaatgctatggcacaggtcatgggaggtacgtcttc

SEQ ID NO: 546 - DNA, 527 bp, Artificial Sequence
  Description of Artificial Sequence: Synthetic polynucleotide
gaagacttagcaggtggtcagggacaaggtggatttggtcagggaaccgttggaaatgccgctgccgcagctgccgctgctgctgcggccgcagccgctcaacaaggaggacagggcggtttcggtggccaaggccagagaggattcggacaacgtgcagcttctgcagtcgcctctgccgcatcggctgcagacgtcggcaataccgtagctaacaccgtttcccgattgagctcaccatctgctgctagtagagtaagttcagcagtggctaacttggtcagtaacggccaactaaatatggccgctttgccatatataataagtaatattagtagttccgtatctgcaagcgttcctggtgcgtcaggttgtgaggtcatcgttcaagctttattggaagtcgtagcagctttatgccaaatcgtttcatcctccaacgttggatacattaatccgtcggccgtgaatgacatcacgaacgttgttgccaacgctatggctcaagttatgggaggtacgtcttc

SEQ ID NO: 547 - DNA, 527 bp, Artificial Sequence
  Description of Artificial Sequence: Synthetic polynucleotide
gaagacttagcaggtgagagcggacaaggaggttatggaggtcgtggtcaaggaggatacggacagggagcaggcgcagccgctgctgctgccgtcgctgctgcagccgcagctgccggacaaggtggatttggaggtcttggcggttatggtcaaggtgccggttcagcaaccgctgccgccagctccgctgacgtctccacaactgtcgctaatagtgtatcaagactgagtagtgcttctgcagctagcagagtctactctgttgtatcaaatctggtttcaaacggtcaagtgaacattgctgcgttaccgaacattatctcaaacgtgagtagttcagtttctgcgtcagcaccaggtgcttctggatgtgaagttattgttcaagttttattggaaattgttgctgccctgacttctattgtctcttctgctagtgttggatatatcaatcaatacgctgtaaatgatataaccaacttggttgctaacgcaatggcaggcgttatcggaggtacgtcttc

SEQ ID NO: 548 - DNA, 365 bp, Artificial Sequence
  Description of Artificial Sequence: Synthetic polynucleotide
gaagacttagcaggtggctacggtccaggtagcggtggttctccggcctctggagcagcatcccgcttgtcaagtccacaggctggtgcacgtgtttcatctgctgtgagtgctttagttgcgtccggaccgacatcacctgctgcggtaagttctgctatctccaatgtcgcctcccaaatatctgctagtaaccctggactttcaggttgcgacgtactggttcaagctctgcttgaaattgttagtgccctcgtctccatattgtccagtgcttcgatcggacaaattaattatggagcttcaggacaatacgctgctatgataggccagagtgttgcacaagcattagcaggtacgtcttc

SEQ ID NO: 549 - DNA, 554 bp, Artificial Sequence
  Description of Artificial Sequence: Synthetic polynucleotide
gaagacttagcaggtgcttctggagctggtcagggtcaaggctacggacagcaagcacaagtctacaaccaaggtggctccggttctgttgctaccaccgctgccgctgcttcgggtgctgtaggagtgtcgcaaaactatgcgcaggctcccgtttactacggaggttcgagctccagttattcctcgtcaatcactagttactcatccagtgtgttgcctattgctattttgcagtcaccagctggtctaacctcatctgcagctggaagcagaatgtcaagcgtcgcgacctccattacttcacttatcccgagtaacggtagtccattcaactatagcgctttctccaatactttggccagtctgattaacaacattggtaattctaatcctggcttgtccagaaacgatgtgaccatcgaagctttactggaggtcatcactgccctgctacaggtgatctccaacggagaattgtcggctgctgctagctcttacgccgccgcaagcctacttcaaagcatccaacaaggttattcaggtacgtcttc

SEQ ID NO: 550 - DNA, 626 bp, Artificial Sequence
  Description of Artificial Sequence: Synthetic polynucleotide
gaagacttagcaggtgcttacggtttcacccaagctgccgcatctgccgttgcttccgttttactgcaagctggtgtcctaaattatggaaacgctactgcactggcatctgcatatgcaagcgcttatgcttcatctgtggcgtccgctgcagcttctgcatcagccggtgcttctgcttcctcgggagcatcagcttacgcatctgctgttgcagcagctgcggctgccgcctctgttagcacctcagcaggcgctagtgcttccgctggagctagtggtctttccttctctcaagctcaagcaagtgccttgtctagttctgctgctgcttacagaattagttctttaattacttcatttgtgtctggtttgtcagcaggtggtggttcagtaaactactcagtgattgccaatgctcttgccagcgtcgcctcacaaatcagtgctagcaacgccggtctgtcagtttcacaagtagcagtccaagctttattagaattctcaactgcgttgattcaaatcttggcatcatcacagattggatacgtaaacactgcatccgctggatctacagcctctgcattttcacaagcactggcacagaccttcgcaggtacgtcttc

SEQ ID NO: 551 - DNA, 521 bp, Artificial Sequence
  Description of Artificial Sequence: Synthetic polynucleotide
gaagacttagcaggtggagccggtcagggtggttatggcggactgggaggtcaaggcgcgggacaaggaggattaggaggacaaagagctggtgccgcggctgctgcggccggcggtgctggtcaaggtggctatggaggactaggatcgcaaggtgctggaagaggtggttacggaggcgtcggttccggtgcctccgctgctagcgcagccgcatctcgcttatctagtcctgaagcttcatcgagagttagcagcgctgtatccaacctagtttcctcaggtccaaccaattctgctgccctttcatctaccatctctaacgtcgtatcgcaaattagtgcctcgaatccaggattatccggttgtgatgtgcttgttcaggctttattagaggttgttagtgccctgattcaaatcttgggttcttcatcaattggccaggttaactacggaactgctggccaagctgctcagattgttggccaaagcgtttatcaggcattaggaggtacgtcttc

SEQ ID NO: 552 - DNA, 476 bp, Artificial Sequence
  Description of Artificial Sequence: Synthetic polynucleotide
gaagacttagcaggtggagcaggtcaaggaggttatggcggattaggtggacagggagtgggaagaggcggacttggaggacaaggagccggtgccgccgctgcaggcggagcaggccagggtggttatggtggtgtcggcagcggcgcaagtgccgcttccgctgccgcgtctcgcttgagctcacctcaagcttcaagtcgtctatctagtgcagtctcaaaccttgtagctactggacctactaactcagctgcgctgtcgtctacaataagcaacgtcgtatcacaaataggtgcttctaacccaggtctgagtggatgtgacgtattaatacaagccctcttagaggtagtttcagccctaattcaaattttgggaagcagttcaataggacaagtgaattacggttcagctggacaagctacacaaattgtcggtcaatccgtgtaccaggccttaggaggtacgtcttc

SEQ ID NO: 553 - DNA, 515 bp, Artificial Sequence
  Description of Artificial Sequence: Synthetic polynucleotide
gaagacttagcaggtccgggaggttacggacctgctcaacaaggcccttcaggtcctggaattgctgcctctgcagcaagcgccggtccaggtggatacggtcctgcacagcaaggaccagctggatatggccctggtagtgctgtcgctgcctccgcgggagccggttctgccggctacggaccaggaagccaagcaagcgctgcggcgagtagactggcctcaccagattccggagcccgtgtcgcttcggccgtgtctaatttggtttccagtggaccaacctcttcggctgccctatcatccgtaataagcaatgcggtttcacaaatcggagcatctaatccaggtttatctggatgtgatgttttgattcaggccttacttgaaattgtatctgcgtgtgttacaatattgtcctcttcgtctataggtcaagttaattacggagctgcttcacagtttgctcaggtcgttggacagtccgttttgtcagcattttcaggtacgtcttc

SEQ ID NO: 554 - DNA, 500 bp, Artificial Sequence
  Description of Artificial Sequence: Synthetic polynucleotide
gaagacttagcaggtcctggtggatatggaccagttcaacagggaccttcaggtccaggatccgccgcaggcccaggaggttacggtccagcccagcaaggaccagcacgctatggtcctggatccgcagctgcggccgcagcagctgccggatctgctggatacggcccaggtccacaggctagtgctgccgcttcgagactcgcaagtccagatagcggtgccagagttgcctctgccgtttctaacctggtatcttccggtcctacatcttctgctgcgctttctagtgtgatttcaaacgcagtcagtcagatcggagcttcaaaccctggattaagcggttgtgatgttctgattcaagcccttttggagatcgtttcagcatgcgttaccattttgtcctcctcgagcataggtcaggttaattacggagctgcatcacaatttgcacaggtcgttggacaatctgttttgtctgctttttcaggtacgtcttc

SEQ ID NO: 555 - DNA, 482 bp, Artificial Sequence
  Description of Artificial Sequence: Synthetic polynucleotide
gaagacttagcaggtggagctggtcaaggtggctacggtggattgggatctcaaggtgctggaagaggaggttatggcggtcaaggagcaggagcagcagccgctgccacaggcggtgctggccagggaggatacggaggtgtcggctcaggagcatctgccgcatcagctgctgcatcccgactttcatctcctcaagcatcgtcgagagtatcgagtgcagtatcaaatcttgttgcctctggacctactaattctgccgctttgtcgtccactattagtaacgctgtttcgcaaattggtgccagtaacccaggtctttcaggttgtgatgtactgatacaagctttattggaggttgtttctgctttgattcatattttgggtagttcttccattggccaagtaaactacggatcagccggtcaagcaacccaaatagtaggacaatctgtttatcaagccttgggaggtacgtcttc

SEQ ID NO: 556 - DNA, 515 bp, Artificial Sequence
  Description of Artificial Sequence: Synthetic polynucleotide
gaagacttagcaggtggagcaggacagggaggttatggaggcttgggaggccaaggatccggtgccgccgccgctggtactggacagggtggatacggcagtctgggtggtcaaggagctggcgcagccggagctgctgcagcagcagttggtggtgccggtcaaggcggatatggcggtgtaggatccgctgctgcctcagctgccgcttcccgtttgtcatcaccagaagcctcatcccgtgtttcgagcgccgtctcaaacttggttagttctggacctacaaattctgctgccttgagcaacaccatcagcaacgtagtgtctcaaatttcatctagcaatcctggactaagcggatgcgacgtcctcgttcaagcactcctggaggttgtgtctgccctcatccacattctgggctcttctagtattggtcaagtgaactatggttcagcaggccaagcgacacagatagtcggtcaatcagtatatcaagctttgggaggtacgtcttc

SEQ ID NO: 557 - DNA, 482 bp, Artificial Sequence
  Description of Artificial Sequence: Synthetic polynucleotide
gaagacttagcaggtggagctggccaaggtggatacggtggcctcggttctcaaggcgcaggtagaggaggttatggtggtcaaggagctggagctgcggttgcagccattggaggtgtcggtcaaggcggttacggaggtgtaggatctggtgcttccgctgcttcagccgctgcaagcagactttcttctcctgaagcatcaagtagagtatcttctgctgtttccaatctagtctctagtggtcctactaactctgctgctttaagctctacaatctcgaatgttgtatcccagattggtgcatcaaatcctggtttaagcggttgcgacgtgttgattcaagctctgctggaagtagtctcagccttggttcatatcttaggcagctcttcaattggacaagttaactacggatccgcaggtcaagctacccaaattgttggccagtctgtttatcaagcactgggaggtacgtcttc

SEQ ID NO: 558 - DNA, 449 bp, Artificial Sequence
  Description of Artificial Sequence: Synthetic polynucleotide
gaagacttagcaggtggttccggaagaggtggatacggctcacagggtgcaggacaaggagctgcagctgctgcggccggaggtgccggtcaaggaggatacggtggtgcaggttctggagccgctgcagcctctgcagccgcgtctagattgtccagtcctgaagctagctctcgagtctcaagtgcagttagtaacctagtttcttcaggaccgactaactcagctgcgctgtcaaatacaatttcttccgttgttagccaaatatccgcttcaaaccctggtcttagcggatgcgacgtgttggtacaagccctccttgaagtcgtttctgcccttatacacattttgggatcttcatccatcggtcctgttaactacggttctgcgagtcaatccacgcagatagtcggacaatccgtttaccaagcattaggaggtacgtcttc

SEQ ID NO: 559 - DNA, 521 bp, Artificial Sequence
  Description of Artificial Sequence: Synthetic polynucleotide
gaagacttagcaggtggctatggaccaggatcaggacaacaaggtcccggtggcgccggtcagcagggccctggaggtcagggaccttatggtcctggaagttcttccgctgcagccgtgggaggatacggaccatccagcggcttgcagggacctgctggtcaaggtccatatggacctggagctgcagcctcagcagctgccgctgctggtgcatctcgtctgtcgagcccgcaagctagttccagagtgagttccgcagtttcaagccttgtctcatccggtccaactaatagtgctgctctgactaacactatttcgagtgtagttagccaaatttcagctagtaacccaggtctatccggttgtgacgtcttaattcaagcactgctcgaaattgtatctgccctagtacacatactaggctacagctccattggacaaatcaattatgacgctgctgcgcagtatgcttctctagtcggtcaatctgttgcacaagccctcgcaggtacgtcttc

SEQ ID NO: 560 - DNA, 560 bp, Artificial Sequence
  Description of Artificial Sequence: Synthetic polynucleotide
gaagacttagcaggtgttttgggaggtcaaggaggattgggtggcttgggatcgcaaggtgctggtcagggaggatacggtcaaggaggtgccggacaaggaggtgctgccgcagccgctgctgcagctgcagcaggaggactcggaggacaaggtggtcgaggaggacttggttcacagggtgcaggccagggaggttacggccagggtggtgctggtgcatcttccgcagcagctgcctcggctgctgcatctagattatcttccgcttctgctgcttctagagtttccagcgccgtctcatctttggtatcatccggtggtccaacgaactcagcggcattatcctcaacaatttcaaacgttgtctcccaggtttcagcgtccaatccaggcctttcaggttgtgatgtattggtacaggccttattagaaatcgtctcagctttagttcatattcttggaagttcatctataggacaagttaactataatgcagccggacaatccgcatccgttgtgggacagtcattttatcaagcattggcaggtacgtcttc

SEQ ID NO: 561 - DNA, 713 bp, Artificial Sequence
  Description of Artificial Sequence: Synthetic polynucleotide
gaagacttagcaggtactggtcagggcggagtcggtggttacggtcagggtgccggttcgtccgctggtgccggaactggtggtgtcggtcaaggcggatacggatcttatggaagttcctaccaatcaacgagcggtatctctatcgcactctctacacaatcattaggtggacaaggtcagtacggccaaggtttgggagccggagcttccgcaggtgctggagctgccgttggtactggtctaggtcagggaggtctaggtggatacggacagggatccggtagtgcttccgccgctgcgtcgggttcaggttctgccattggtggatttggtggctatggtcaaggagctggcctaggagctggaaccgcagccgacgtaggcgctacggtaagtaatactgtttctagactgtcctccccagctgctaccagcagagtttcatcagcggtcagttcgcttgttgctaatggtgcacctaatttatcatctttaccaaatgtaatcagtagtttatccaactcagtgtccgctagtaccccaggcgcttctggatgtgaaatactggtgcaagtcctgatggaggtcgtcaccgcattggtacagatattatctagtgcaaacgtatcaagcgtgaacgccggtgacccatctcaagccgctatgactgttggtcaatctgtggcagccgctcttggaggtacgtcttc

SEQ ID NO: 562 - DNA, 647 bp, Artificial Sequence
  Description of Artificial Sequence: Synthetic polynucleotide
gaagacttagcaggtgcttcttccaacgcaagttctgctgccgctgcagcttctacagttctagctggcgttgcaccagctggatcatccgcttctagttcagctgcctcagcatcaactggtgccggcgctgctatttcttccgtaggaccagccgttggattcggcgccggtcctgccccagcaggaggtttggtttcaggactaccaggctattcaccactgaatcagggctttacgccatacccgggagtacctttgccaactggatcaggtgtctcagcaccagtgcctgtatctcctctaccactcggtttgttaccttcatcgttggacttgtcatcacctagtgctaccggacgtatgtcatccctcgtacgttcattgctgagtgccgtcagttctggaggattgaactcgagtctcttgggatcaaccctgacttctctggtgtcgcaaatttcctcaagcaggtcggatttgtcggcatctcaagtcctggtggaggccgtgcttgaaatcctatccgctgtaatccaaattctatcaagtgctacaattggtgttgtatctaccgactctgtcggtgctacttcaagtgccgtggcacaagcagtttcttcggcgtttgccggaggtacgtcttc

SEQ ID NO: 563 - DNA, 449 bp, Artificial Sequence
  Description of Artificial Sequence: Synthetic polynucleotide
gaagacttagcaggtggtttgggtggtggacaaggtggatatggatccggactaggaggagttggtcaaggaggccaaggtgcattaggtggtagccgtaacagtgcaactaacgctatatctaattccgctagtaacgcagtatcactactttcatctcctgcatctaatgctagaatctcctccgccgtatctgcattggcgagtggcgccgcctcaggtcctggttacttgagctccgttatctccaacgttgtttcgcaagtttcctcaaatagcggaggcttagtaggatgtgatactttggtccaggcactactcgaagctgcagctgctcttgttcacgttttggcttcttctagtggaggtcaagtaaatctcaatactgccggttatacttcacaaatggtgtcccagaccattgctcaagtctttgcaggtacgtcttc

SEQ ID NO: 564 - DNA, 437 bp, Artificial Sequence
  Description of Artificial Sequence: Synthetic polynucleotide
gaagacttagcaggtggcctcggaggtggccaaggaggccaacagggcgctggtagaggtggtctgcaaggtgccggtcagggtggacagggtgccttaggaggatcaagaaactccgctgccaatgcggtttcgagacttagctcgccagcctctaatgccagaatctccagcgctgttagcgctttggcatcaggaggtgcaagctcacctggttatctgtcatcaataatttccaatgtcgtctcccaagtgtcctccaataatgatggtctttccggttgtgataccgtcgtccaggcattgttagaagtcgccgccgcacttgtccacgtcctagcttcaagcaatataggccaagttaatttgaatactgcaggatatacctcgcaaatggtttcgcagaccattgctcaagtgttcgcaggtacgtcttc

SEQ ID NO: 565 - DNA, 434 bp, Artificial Sequence
  Description of Artificial Sequence: Synthetic polynucleotide
gaagacttagcaggtggaagcggcggtcaaggtggacagggcggttacggatctggaggacaaggtcaaggacagggtggatatggtagcggtgcggcttctgctgccgcggcagcatcctcatccgtcagccgtctccaatcccctgcttccagctcaagagttagttcggccgtatctactttggcctcagcaggagctgctaactcgggagctttgtccagcgtcatttctaatctgagctcttctgttgccagtgctcaccctgacttgtctggatgcgaattacttgtgcaaattcttcttgaggtgatcagtgccctagtcgcattacttggctcatcaacagtgggacctgtcgatattggtcaaagcagtcagtactctggtctggtcgcaaacgctataggtaatgctctcgcaggtacgtcttc

SEQ ID NO: 566 - DNA, 422 bp, Artificial Sequence
  Description of Artificial Sequence: Synthetic polynucleotide
gaagacttagcaggtcctggtcaacaaggtccttatggaccatcccaacagggtccaggtagctacggtccatccggtcaagtttcatccgttagtgcctcagtttcttccgccgctagtagattgtcaagtccagctgcttcctctagagtctcatctactgtctctagcttggcctcatcgggaccgtctgacgccagtgtggtttcaagcgcattaagtaacttagtcagtcaagtatcagctagtcaaccaggtctgtccggatgcgacgtcatcgtgcaggctttgctggaactcgtttccgctttagtccacatcttgggtagttcttctctcggacaagttgactacaacggcgcatcttacagtgctcagaggctgtcccaagcattaggaaacactcttggaggtacgtcttc

SEQ ID NO: 567 - DNA, 431 bp, Artificial Sequence
  Description of Artificial Sequence: Synthetic polynucleotide
gaagacttagcaggttccggagccggtgccggatcagccgctgctgccggtgcgggagttggagctgctggtggatatggaggtggagccggcgctggagctgtagcaggagcctcggcaggttcatacggaggagctgtcaacagactctcatctgcaggagccgcttcccgagtcagctcaaacgttgcagctatagcctcagctggtgcggctgctttaccaaatgttatctctaatatctacagtggtgttttgtcaagtggagtgagttcctccgaggcccttatccaggcattgttagaggtcatttcagcactgatacatgtccttggatcagcttccatcggtaatgtttcttctgttggtgtgaatagtgcattgaacgccgtccaaaatgctgtcggagcctacgctggaggtacgtcttc

SEQ ID NO: 568 - DNA, 398 bp, Artificial Sequence
  Description of Artificial Sequence: Synthetic polynucleotide
gaagacttagcaggtcagggtggatatggtggaagcgcttacggtggccagggcgctactgcttcggctgcggcagcctcagctgctgccagtagattgtcctctccatccgcagcatctagagtttcttccgcagtctcaagccttgtgagcaatggaggtcctacatcaccagcagctttgagctctagcatttccaacgtggtatctcagatctctgcatcaaacccaggactttctggttgtgatatattggttcaagctctattagaaattatttctgcattagtgcatattctaggaagttcatccattggtcaggtaaacagctcgagtgccggacaatctgcctccattgtcggacaaagcgtgtatagggcactgtcaggtacgtcttc

SEQ ID NO: 569 - DNA, 524 bp, Artificial Sequence
  Description of Artificial Sequence: Synthetic polynucleotide
gaagacttagcaggtggtccaggtggccctggtggtcgtggaggaccaggacgttcaggtggtagaggaggcctcgaaggtgctggtgcatcgggaggtttcggacctgtagcgggaggagcttcacccggagcaggtggttctggttctactactgtcaccgaagttgttagtgtgaccgtatccggaggacaacctagttcaggcgtgctgccgggtggctcttacacccctgccgccggtggatccgctcgtttaccttccctgataaatggaatcatgtcctctatgcagggtggaggattcaactatcaaaatttcggaaacgtcttatctcagttctccactggtaccggaacgtgtaatagtaatgacttaaacctgctaatggatgcactattagcagcattgcatactctatcgtaccaaggtatgtccactgtcccatcttacccatccccgtctgctatgtctagttattctcagtcagtcaggagatgctttggatattcaggtacgtcttc

SEQ ID NO: 570 - DNA, 386 bp, Artificial Sequence
  Description of Artificial Sequence: Synthetic polynucleotide
gaagacttagcaggtgtcggaccgggaggtgcttatggtccaggtgccggaggactgtctggagtgtctagtggtgctggaggaattagaggtggtcaaacctacggaggatcttctagattaccatctttagtgaatggactcatgggatccatgcagccttctggtttcaactatcagaacttcggtaacgttatgtctcaatatgcaactggatctggtacgtgtaacagtaatgacgttaacttactaatggacgccctcatggcagctttacattgcttatcttacggatcaggatcggttccacctacccctacctactcggccatgtccgcttacaatcaatccataagacgaatgttcgcatactcaggtacgtcttc

SEQ ID NO: 571 - DNA, 386 bp, Artificial Sequence
  Description of Artificial Sequence: Synthetic polynucleotide
gaagacttagcaggtcagcagggttactcatctagctcaagcgctggcgctagctctgccgcaacggccagcgcagccgcttctagactcagtagtaccgattccagttcacgagtatccagtgctgtatctagcctggtcagtaatggaccttctaacccggtggccttagctaatgctgtttctcgtgttatgtcgcaagtgaatgcttcctcttctggtttatcagaatgcgacgttttggtgcaagctttgctcgaaatcttaagtgccctggtacatatacttggaagcgctactgtcggcgaagttaattacgacgctacatcacaaaccgcacaaatggtcagccagactatagctcaggtattcgcaggtacgtcttc

SEQ ID NO: 572 - DNA, 419 bp, Artificial Sequence
  Description of Artificial Sequence: Synthetic polynucleotide
gaagacttagcaggtccaggaccgcagggtccatctggtcctggtccacaaggtccttctcctcaaggaccaagcagtggatatgatcagtcggtcgtaattagctcagcaagttcccgtttgtcatctcctagtgcgacttcccgtatctcttcggcaatttcaacgctaaagacttcgggtcctagaaacccagtgggattgtcaactgccttaggtaatatcctaagccaaattcaattgacaaatcccggtctgtcgggttgcgaatctttagttcaggcccttttagagattgtgtcagctctgatccaaatcttatctgtcagtagtgtaggacctgttgatttctccgctactggacaaagtgccgctatcgtgggacaagctttgatgcaatcactaggaggtacgtcttc

SEQ ID NO: 573 - DNA, 485 bp, Artificial Sequence
  Description of Artificial Sequence: Synthetic polynucleotide
gaagacttagcaggtggagcagcaggttccggagttggatacggtggtgcttcaggtgttgttactagttcctcaagcgcttccgcaggaggttcgggtatcataacttatggtggttatggatatggagctggtgctgctgcaggtgccggtgctggtgccgtcgccggttcctatggaggcgcagttaatagacttagttcagctgaagctacgaaccgtgtctcaagcaatgtcggagcaatagttagcggtggcgtgtcagcactaccatcggtaatttcgaacatcttttcaggagtgaatgcatcggctgcaggagccagctatggcgaagcactgattcaatctcttatggaagtggtatcagtgctcctacacattttgtctaattctagtatcggttatgttagtagtgagggtctgggcaattctttaagcgtcgtccaacaagcaattggacctctcgctggaggtacgtcttc

SEQ ID NO: 574 - DNA, 443 bp, Artificial Sequence
  Description of Artificial Sequence: Synthetic polynucleotide
gaagacttagcaggttcgtcatttgcgaatgcagcttccgctgcacccgctgtttcagttgatggtcctgtagttgtctctggtcaagtcctaccggcttctttgttgactgctcttgcaccagttgtgtccagttctggcctagcatcctcaacggcctctgctagagtttccagcttggcacaaagcatagctagtgccattagcagtagtggtggaacactatctgtaccaacctttctcaatttgctctcttcggctggtgcccaagtcactaccagcagtactttgaattcttcacaagttacgtctcaggtattattagagggtatcgccgcccttttgcaagtgatcaacggagcccaaatccgaagcgttaatttggcaaacgccccaaacgttcagcaagcacttgtatcagcattggcgggaggtacgtcttc

SEQ ID NO: 575 - DNA, 614 bp, Artificial Sequence
  Description of Artificial Sequence: Synthetic polynucleotide
gaagacttagcaggtcaaggtaccagtttcgctagctccgctaccgccggaatacgaaatatcttcggcaaccctaacactgcaaataattttgtcgactgtttgaagggaggaattcaagcttcacctgcgtttccacgtcaagagcaagccgacattcaatcgattgcctctagcattctgtccgctggtaacaccgcaacgaagtctaaagccatcgagcaagctttgtctactgcccttgcctcgtctctcgcagaaatcgttatcaccgaatccggcggtcaggattactctaagcagattaccgatcttaacggaattttgagtaactgtttcatacaaaccacaggagttgagaacaagaggttcgtgaattcgattcagaaccttatccggttgttggctgaatccgcggtttcagaaactactaacagtatccaaatcggtccatacgcttctacctcgtccaactcattttcagattcgtctgccaatgacgcctctggagcttatgccttctcacaaagttcagcctccacgttagcaagctctagcgcttttagttcagctttttcaagcgcttcctcggcctccgccgtaggtacgtcttc

SEQ ID NO: 576 - DNA, 614 bp, Artificial Sequence
  Description of Artificial Sequence: Synthetic polynucleotide
gaagacttagcaggtcaatccgtagctgtcacagctgttccgtcagttttctcttccccgaatttggccagtggctttttgcaatgcctgacctttggtattggaaattctcccgcattcccaacccaggagcaacaagatttggacgctatcgctcaagttatactgaatgctgttagcaccaatactggagctactgcctccgcacgagctcaggctttgtcgacagccttagcctcatctttaacagacttgctgatcgcagaatctgccgagtcaaattacaacaatcaattgtctgaacttaccggaatcctatcaaactgttttatccagacgacaggttccgataaccctgcttttgtgtctagaattcaatctctgatctctgttctgtctcaaaacaccgatgtaaacatcattagcacagcaggtctgccaactgctattagtggagcaggtggtttcggatttgccaagactgcatctagctcagcgagccaagcttcagcgtcgagctttgcacaggcctcgtccgctagtttggcagcttcttcgtcgttctcaagtgcctttagttctgcgaatactttatctgcattaggtacgtcttc

SEQ ID NO: 577 - DNA, 632 bp, Artificial Sequence
  Description of Artificial Sequence: Synthetic polynucleotide
gaagacttagcaggtcaaagtgtagccgtcacagccgtcccttcggttttctctagtccaaacctggcttcaggattcttgcaatgcttgaccttcggtataggaaatagccctgcatttccaactcaggaacaacaagacttagacgcaatcgcccaagttattttgaatgccgtctccagtaacaccggagcaactgctagtgcacgagcgcaagccttgagtacagcattggcctcctctttgaccgacctgcttatcgccgagtctgctgaatcaaactactcaaaccagttgtctgaattgacgggtattttgtctgattgttttatccagactactggtagtgacaaccctgcctttgtgtccagaatacaatccttgatctcagtattgtcccagaacgcagatactaatatcatctcctctgcaggtattccatcagtgagtggccgacggggagccggtggtctaggcttcgataataccgccagacaaagcgcatcatccgccgcttcacaagcttctgctagttcatttgcacaggcttctagcgcatcgttggctgcgtcctcagccttctcatcagctttcagttcagctaattccctgagtgccctaggtacgtcttc

SEQ ID NO: 578 - DNA, 443 bp, Artificial Sequence
  Description of Artificial Sequence: Synthetic polynucleotide
gaagacttagcaggtcaacaatcaaagtttggacaaaggtttccatcagtttcgcacatatggaacaggaagttttctcgtatctcgtactctagaacaactcgtcttggttgtcactgtccaggtgatactcaatgtaggttcaaacaacactggcgtcactcaatcggtcagtcatcaggattcaagtactcagcctgcatcttttcttctgctaattcgcttagcgccctgggtaacgtcgcctatcaactgggttttaacgtagctaatactttgggaataggtaacgccccaggtctgggagctgcattgagtcaagctgttagtagcgttggtgttggcgcttcgagctcgacgtacgcaaatgttgtaagtaacgcagtaggacaatttttggcaggtcaaggagtattgaatgccgccaacgcaggtacgtcttc

SEQ ID NO: 579 - DNA, 779 bp, Artificial Sequence
  Description of Artificial Sequence: Synthetic polynucleotide
gaagacttagcaggtctgccagcaaactctctgtctggagtgtcggccagtgttaacatattcaactcccctaacgccgcaacctcgttcttaaattgcctgcgctcaaacatagaatcaagtcctgcgtttccttttcaagagcaagccgacctggatagcattgctgaggttattctatctgatgtgtcctctgtcaacaccgcctcctctgctacttccttggctctgagcaccgctttggctagctcacttgctgaactcctagttacggagtcagctgaagaggacatcgacaaccaggttgtggccttgagtactatcttgtcccagtgtttcgttgaaactacgggatccccaaaccctgctttcgttgcttctgttaagtcactcctgggtgttcttagtcaatctgctagcaattacgagtttgtggaaactgctgatgaatctattgcagcaaacgttccaggcataactacaacaggtaacttcacgccgttaaacgcaattgagcaaaattttgtatcaagcctggcgtcgtctccaagtcttgcgcgtacattctactccgtaagcaacgcagatcaggctgcaaacattgcctataacctaggtcttaacattgctccatctttaggtatcccaaattccgaggcacttgcttcaagcttgcgtcaagctgtggcaagcgcaggtgaaggtgttaattcatcaacttacgctaatcttgtatctaacacattgggtcagttcctgagctcgcaaggtacgtcttc

SEQ ID NO: 580 - DNA, 743 bp, Artificial Sequence
  Description of Artificial Sequence: Synthetic polynucleotide
gaagacttagcaggtcaggctatatcagtcgctacgccagttccctcggttttctcttcgccatctttggcttcaggatttcttggatgtttgactaccggtattggtctttcacctgcattcccttttcaagagcaacaagacttagatgatcttgctaaagtaattctttccgctgtaacttcaaatactgatacatccaagtctgctcgcgcccaggctctttcaaccgctctggcatccagtttggccgatctgctgattagtgagagtagtggatcttcttaccagacacaaatctctgcccttacaaatattctgtccgactgtttcgtgacgactacaggatccaataatcctgctttcgtctctagggttcaaactcttattggtgttttgtcccaatcttcaagcaacgccatatcaggcgctactggtggaagtgctttcgcccaatcccaagctttccaacaatctgctagccaaaacacaggcctttccgcatctcgagccggatctacgtctagcagtaccacaacaacgaccagtgccgcagcttctcaggctgcatcccagagtgcatcgagttcaagctcgtatgcctttgctcaagcagcatcgtccagtctggcaacaagctcagcaatctccagagcatttgcatcggtgagttccgcctcggccgcctctagtttggcgtatacaattggattgtctgccgcaagaagtttaggtacgtcttc

SEQ ID NO: 581 - DNA, 545 bp, Artificial Sequence
  Description of Artificial Sequence: Synthetic polynucleotide
gaagacttagcaggtcagccaatctggaccaaccctaatgctgccatgacaatgaccaacaatcttgttcagtgtgcaagtagatcaggagttctgacagcagatcaaatggatgacatgggaatgatggccgactcggttaattcccaaatgcagaaaatgggtccaaaccctcctcaacacagactcagggccatgaacactgcaatggctgcagaagtcgcagaagtggttgcgacctctcctccacagtcttactctgctgtgttgaacacaattggtgcttgcttacgcgagtcgatgatgcaagctactggttcggtggacaacgccttcacaaatgaggtgatgcagctggtgaaaatgctatccgctgattctgctaacgaagtttcgacagcttctgcatctggagcctcgtatgctacttctacatcgtctgctgtatcatcttcccaggccacaggttatagtaccgctgccggatatggcaatgcggctggtgctggtgcaggtgcagcagctgcggtgtcaggtacgtcttc

SEQ ID NO: 582 - DNA, 515 bp, Artificial Sequence
  Description of Artificial Sequence: Synthetic polynucleotide
gaagacttagcaggtcatatctggggaaccccaggagccggaaagtctgttactggttcgatcgtccagtgcgctggacaatctggagtcttttctggtgatcagatgcaagatcttggagatatggctgacgctgtcaatagacagttagatcgtttgggtccaaacgctccagatcaccgactcaaaggagtgactactatgatggctgctggtattgcggacgccgctgttaactctccgggtcaatcgctagacgtgatgatcaatacaatctctggctgcatgacacaagccatgtctcaagctgttggttatgtcgaccagaccctgattagggaagtcgcagaaatggtcaacatgcttgcaaacgaaaacgcaaacgcggtatctacctctggaggtgttagtggtggatcgtacgaggttagtcagtcctcatctgcttctagtgccaccgctcaggcgggttattcctcttctgtacaatttggaacctcatcaggtacgtcttc

SEQ ID NO: 583 - DNA, 716 bp, Artificial Sequence
  Description of Artificial Sequence: Synthetic polynucleotide
gaagacttagcaggtgccttgggtcagggagcttcagtatggagctctcctcaaatggccgaaaattttatgaatggtttttcaatggccctttcccaggcgggtgccttttccggtcaagaaatgaaagactttgatgatgtaagggacattatgaatagcgcaatggacaagatgatcagatctggcaaatctggtaggggcgctatgagggcaatgaacgctgctttcggatccgctatagccgaaatagtggcagcgaatggtggtaaagagtatcaaataggagctgttttggacgctgtcaccaatactctgctacagttgacaggaaacgctgataatggattccttaatgaaatttccagattaatcactctattttccagcgtagaagctaacgatgtttctgctagcgctggtgcagacgcttctggctctagtggacctgttggcggatattcatctggcgcaggcgcagctgtcggtcaaggcactgcccaggctgttggctacggaggcggtgctcaaggagttgcctcatcagctgccgctggagccactaactacgctcagggagtttctactggatcaacacagaacgttgccacctccacagtcactactaccactaatgtagccggatccaccgcaactggttacaacaccggttatggtatcggtgcagcagccggtgctgcagcaggtacgtcttc

SEQ ID NO: 584 - DNA, 818 bp, Artificial Sequence
  Description of Artificial Sequence: Synthetic polynucleotide
gaagacttagcaggtagaggaatcattgctaattcgcctttctctaaccctaatacagctgaagcttttgccagatcattcgtgtccaacatcgtttcttcaggtgagttcggtgctcagggtgcagaggacttcgacgatataattcaatctttaattcaagctcaatcgatgggcaagggacgtcacgatacaaaggcgaaggccaaagctatgcaagttgcccttgcaagctctatcgctgaattggttattgctgaatctagcggtggtgacgttcaacgcaagaccaacgtcatttccaacgcattacgaaatgccctgatgtcaaccacaggtagcccaaacgaggaatttgtgcatgaagtccaggaccttattcagatgttatcacaagaacagataaatgaagttgacactagcggccctggtcaatactaccgttcttcatcatcaggaggaggtggtggcggacaaggtggaccagttgttaccgagacacttaccgttactgttggcggatctggaggaggtcaaccaagtggtgcgggaccaagcggtaccggtggctatgcccctacaggttacgctccatctggatcaggcgctggaggtgtaagaccatccgcctcaggtccttccggttcaggtccgtccggtggttctaggccttcaagctctggtcctagcggtacacgtccatctcctaatggtgcctctggttcaagtcctggaggaatcgcaccaggtggatcgaacagcggaggtgcgggagtatctggagctaccggaggaccggcttcctcaggtacgtcttc

SEQ ID NO: 585 - DNA, 740 bp, Artificial Sequence
  Description of Artificial Sequence: Synthetic polynucleotide
gaagacttagcaggtcgtggtatcatcgtaaattcccctttttcgaatccaaacactgcggaggcatttgccagatcattcgtttcgaacgttgtttcctctggagagttcggtgcccaaggagctgaagattttgatgatattattcaatctttaattcaagcccagtccatgggaaaaggcagacatgatactaaagccaaagctaaagctatgcaagttgcattggcctcgtccatagctgagttggttatcgctgaatcatctggaggagacgttcaaagaaaaacaaatgtgatttcaaacgctttgagaaacgccctaatgtcgacgactggctctcctaacgaagagttcgtccatgaagttcaagatctaatacaaatgctgagtcaagaacaaatcaacgaggtggatacctctggtccaggtcaatattatcgtagctcttcgtctggtggaggtggtggtggaggaggtggacctgtcataacagaaaccctcacagttaccgtcggtggaagtggagcaggtcagccatcaggagccggtccatcgggaactggtggttatgcgccaacgggttacgctccaagcggctctggtcctggaggagtcagaccatctgctagcggaccttccggttctggtccttctggatcccgtccctcgtcatctggatcttcaggaactcgtcctagcgcaaatgccgctggtggttcgagcccaggtacgtcttc

SEQ ID NO: 586 - DNA, 746 bp, Artificial Sequence
  Description of Artificial Sequence: Synthetic polynucleotide
gaagacttagcaggtgttcaagtagagggtcgtaaaggtcatcatcatagctccggttcgtctaaaagcccttgggcaaacccagctaaggcaaacgccttcatgaagtgcctgatacaaaaaatttctacttctcctgttttcccacagcaggaaaaggaggacatggaagagatcgtcgagacaatgatgtcggccttctcaagtatgtctactagtggtggttcgaatgctgccaagctgcaagcaatgaacatggccttcgcttcgtctatggccgaattagtgatcgccgaggacgctgacaacccagacagtatttctattaaaactgaagccttggccaaatccttacagcaatgtttcaaatccactttaggttctgtgaacagacatttcatagctgagattaaagacctcatcggaatgttcgcaagagaggctgcggccatggaggaagcgggcgacgaagaggaagagacatacccatcagcctttgaaatccctgaccaatccatctccgttcctagcgcagattttatttcaggaatggataccttcattggattcggaggaacctctgcttccggtgacgtgtcagctaagttatctaaatctctgctctcttctttggcctcgtctggagtttttagagccgcatttaactcaagggtcagtactcctgttgcagtacagctcactgatgctttggttcagaagatagcgagcaacttaggtacgtcttc

SEQ ID NO: 587 - DNA, 824 bp, Artificial Sequence
  Description of Artificial Sequence: Synthetic polynucleotide
gaagacttagcaggtttggattacgccacggcaagtaaattacgtaaggcgtcgcaggctgtttccaaggttagaatgggttctgacaccaacgcttatgctctcgcgatttcctctgcattggctgaggttttgtcaagtagtggaaaagtcgctgacgcaaacataaatcagatagcacctcagttagcttcaggaattgtgctaggtgtctccacaactgctccacagtttggagttgatttatcttccatcaacgttaacctggatatttcgaacgttgcaagaaatatgcaagcctccatccaaggcggcccggctccaattaccgctgagggtcctgattttggagctggttaccctggtggtgcaccaactgacctttctggattagacatgggtgccccatctgacggctctagaggaggtgacgcaaccgcgaaattgcttcaagctcttgttccagctttactaaaatccgacgtattcagagcgatctataaaagaggaacgcgtaaacaggtggtccaatacgttacaaatagcgctttgcaacaggcagcaagttctttaggattggacgctagcacaatttcccagttgcagaccaaggccacgcaagcactatcctcggtgtctgccgatagtgactcaactgcttacgcaaaagcttttggtttggctattgcccaagtgctaggcactagcggtcaagtcaatgatgctaatgtcaaccaaatcggcgctaagttagcaactggaatcttgagaggaagttccgctgtcgccccacgtttgggaattgatttgtcaggtacgtcttc

SEQ ID NO: 588 - DNA, 458 bp, Artificial Sequence
  Description of Artificial Sequence: Synthetic polynucleotide
gaagacttagcaggtcaatctaatccgtggacagacacggctacagccgaaagtttcatatcctctgttatgtcctcggttgctaaccaaggttgcttgagctatgaccaaatcgatgatatgcaagccgtgggtgacactatgttagctacaatggacaaccttgtccgatcaggtaagtcatctagccacatgttgaaggccatgaacatggccatgggtacatctatcgctgaaattgttgctgatggcggtggaaatttaggtagcaaagtgtcttgcatctctaacgctctgtctagtgcgtttctacaaacaacaggatccgtcaatacacagtttgtgaacgagatcgtcagcttaatctcgatgttcgcacaagcagacacaaacgaagtcggcgttggatcgggctcaggagcaggagctggaagtggtgctggtgcaggtacgtcttc

SEQ ID NO: 589 - DNA, 530 bp, Artificial Sequence
  Description of Artificial Sequence: Synthetic polynucleotide
gaagacttagcaggtgtgggacaagccgcgaccccttgggaaaactcgcaacttgcagaggattttatcaattcttttctcaggttcattgctcagtctggtgcattctccccaaaccaacttgacgatatgtcgtccattggcgatacacttaagacagctatcgagaaaatggcacagtctagaaagtctagtaagagtaaactccaggctctgaacatggctttcgcatcctctatggctgaaattgccgtggcggaacaaggcggactatcactggaagctaagaccaacgctatcgccaatgctttggctagtgcttttctggaaacaaccggattcgttaatcaacagtttgtttccgaaataaagtctttgatctacatgatcgcacaagcttcatcaaacgagatttccggaagcgccgcagccgcaggaggtggcagcggcggtggtggaggatcgggacagggaggctatggtcaaggtgccagtgcgtccgcctcagctgctgcagcaggtacgtcttc

SEQ ID NO: 590 - DNA, 779 bp, Artificial Sequence
  Description of Artificial Sequence: Synthetic polynucleotide
gaagacttagcaggtgtttttagcgctggtcaaggtgctactccttgggagaattctcagttggctgagtcttttattagtcgttttttaaggtttattggtcaatccggtgcattctctcctaatcaattggacgatatgtcatcaatcggagacacactgaaaactgccattgaaaaaatggctcaatccagaaaatcttctaagtcaaaattacaggcccttaacatggcatttgcctcctcaatggccgagattgccgttgccgaacaaggaggtttgtccttggaggcaaaaaccaatgctatcgcttcagctctgagtgctgctttcttggaaactaccggttacgtaaaccagcagttcgtgaacgaaatcaaaactctaatcttcatgattgcccaagcttcttctaatgaaatcagcggtagtgctgctgcggcaggaggttcttctggtggaggtggtggcagtggtcaaggaggttatggccaaggtgcttacgctagtgcctctgctgctgctgcgtacggttcagcaccacaaggtactggaggtcctgctagccaaggtccttcccaacagggtccagtatcacaaccttcgtatggtcccagtgccacggttgccgtgactgccgtcggcggtcgtccgcaaggccctagtgccccaagacaacagggacctagtcaacaaggaccaggacagcaaggacctggaggtagaggtccatatggtccttccgccgcagcagctgcagccgctgcaggtacgtcttc

SEQ ID NO: 591 - DNA, 659 bp, Artificial Sequence
  Description of Artificial Sequence: Synthetic polynucleotide
gaagacttagcaggtagaaccaaagttactaacgttccttggactgatgaggctaaaggaaaaaagttcctctccacttttcttgactacgcgttagatcatggactcttccctcaacaagagcgtgatgatctagaagccattagtcaaaacttaattccggtttttcgaaagacaatggattctggtggaaacgccgcggctaagatgaaggccttgaatatggcttttgcttcgtctattgcagagatagcagtgcaagaaggtggtgcgggatcaattgaagagaaaactcaggctgtttctgaggctttagctcatgcgttccttcagacaacaggttctgttaacatccaattcattaaagagattagagcactcattacgctgtttgccaaagaaggccaggataacgaaacagaaaacgaaattccaacccagcaagcataccctgagctgcaacctagaggtggcggtttgcaaggccagccaggtcaatacgaatccgttagagcaaactacgccggttccggtggtgctagccgtggtcaagctgcaaaggaagattcaggcgctgctgccgcatcttcttccagcacatccacatcaactactacaactagttcagcagcggctgccgccgctgcaggtacgtcttc

SEQ ID NO: 592 - DNA, 896 bp, Artificial Sequence
  Description of Artificial Sequence: Synthetic polynucleotide
gaagacttagcaggtgcttcaagttatgcctctgcaaatactacgccatggcgagacgctgctacagctcaagctttcataggcaattttatgcaagctatctgctatgatcctgttattaatcctcaacagtgcgacgatatgaattctatggcaagcacaatcctggctggtgttcagaacatggccagagatggtaaaatatctaaagcgaagctgcaagctatgaatatgggattcgcatcggccattgctgagattgcacttgtcgaaggaggtgccccagccgaaaacgctgtggttaatgctatgcaatccgctatctggcagagcactggttcgcccaaccgttcctttattaatgaaatgaaagcactcatgaagatgcttgcccaacaatccaatttcgtggccgccgctgcttccactgcagcgtccgccagtagtcaggctaccgccccagcttatggaggaggtagcggtagtgccgttgcatctgcctcttcgcaaggaacagctccagcctatggtggtggctcgggttctgctggtggtcagggtcaaggtcagggttcttccggtcaacaaggccaaacacaaggaacttatcagtacactgttagcatgagcactgctacttctacttatggacagcaatccgccggacaacaaggaggccaaggtggagcccttcaaggtggtcgacaacagggtggccaaggtccaaacggaccaggagcttctgccgccgcatccgcttccgctggagcaccagctgctgctgctcctggaggatatggtggtccaggtcagcaaggacctggtcaaggacagaaaggaccagcgacttcagcagcagctgccgccgcgagcgcaactgcagcaggtacgtcttc

SEQ ID NO: 593 - DNA, 767 bp, Artificial Sequence
  Description of Artificial Sequence: Synthetic polynucleotide
gaagacttagcaggtcaccagggacctcatcgaaagacgccctgggaaacaccagaaatggctgaaaacttcatgaataacgtaagagaaaaccttgaagcatctagaatcttccctgacgagttgatgaaagacatggaggctataaccaacaccatgattgctgctgttgacggtctggaggctcagcatcgatctagctatgcatcccttcaggctatgaacacagctttcgccagtagcatggctcaattatttgcaacagagcaagattatgtggataccgaagtcattgccggtgctattggtaaagcctaccagcaaattactggttacgagaatccgcacttagctagtgaggttactcgactgattcaattatttcgcgaggaggatgatttggagaatgaagtagaaatatccttcgccgatactgacaatgccattgctagagcggctgctggtgctgccgctggatcagctgctgcttcttcctcagccgatgcttcagcgacagctgaaggtgcatcaggtgatagtggtttcttattttccacaggaacctttggaagaggtggtgctggtgcaggcgcaggagctgctgctgcatccgccgccgcagcttctgccgcagcagcaggtgccgagggcgacaggggtttgtttttcagtacaggtgattttggtcgtggaggagccggagctggtgccggtgctgctgcagcctcagccgctgccgcttcggctgccgcagcaggtacgtcttc

SEQ ID NO: 594 - DNA, 452 bp, Artificial Sequence
  Description of Artificial Sequence: Synthetic polynucleotide
gaagacttagcaggtaacacaccattcgctaataaaattatggccgaagattttatgaataaatttacaaaccaactggccaatagcccatatttctcctcacagcaaaaagaagatatgagttctatcaaggacgagcttatatctgtaatagagagtatggattcggctcacaaatcttcagcggcaaaactacaggctatgaacatggccttcgcgagtgctattgcagatatcgctgctactgaagcttatggtgctgacatctctctcgagacgtccgcaatcgctaacgcactttctgaagccttcctgcagaccaccggtgtggtcaataagaggttcatcagtgagatccaagaattgatttatatgttcgctcaggacgccagcgtccaatctaatgagattgcctcctcctcgtctgctgctgcagctgcaggtacgtcttc

SEQ ID NO: 595 - DNA, 557 bp, Artificial Sequence
  Description of Artificial Sequence: Synthetic polynucleotide
gaagacttagcaggtagtagctctcttgcttcacataccaccccttggaccaatcctggactagcagaaaactttatgaactcttttatgcaaggtttgtcctcgatgccaggatttactgcaagtcaactggatgatatgagtaccattgctcaatctatggtacaatcaatccaatcgctcgcagcacaaggaaggacttctccaaataagttacaagcactaaatatggcttttgcaagttctatggccgaaatcgcagctagcgaagaaggtggaggcagcctgtctactaagacctcaagtattgcttctgctatgagcaatgcttttctgcaaaccacaggtgttgtcaaccaaccattcattaacgaaatcacgcagcttgtgtccatgttcgcacaagctggtatgaatgacgtaagtgcttccgcttcggcaggtgcctctgccgctgcttcggccggtgcacctggatactctccggctccgtcttactcctctggtggatacgcaagctcagcagcttccgccgccgcagctgcaggtacgtcttc

SEQ ID NO: 596 - DNA, 494 bp, Artificial Sequence
  Description of Artificial Sequence: Synthetic polynucleotide
gaagacttagcaggttttgttgttcaaggtcgccaacataacgccgctaattccccatggtccaacgctaagaccgccgagatttttatttctaaatttatcagcgcgatcctggactccaatgcattcacacgtgaacaaaaggaagatatgatgtctataggtgaaaccatcatcccagctatggagaagatgtctggtagttcgaagtccatacatgctaagctaaccgctctgaacatggctttcgcctcttctgtcgctgaaattgctgtggttgaggagggtggatccgacattaacgagaaaacatacgccatcgtggctgctctcaaccaagcctttctggatacaacgggaaaagttaataaacaattcattgcagagatcagggatttggtcaaaatgtttgcatcagctaacgaagaaaacgaaataggtgcggcgctatcagctgagatttacacggaacaaactggctcaggtacgtcttc

SEQ ID NO: 597 - DNA, 671 bp, Artificial Sequence
  Description of Artificial Sequence: Synthetic polynucleotide
gaagacttagcaggtagagcatacggagcaggagctggcgctggtgctgaagagggttacggtgctggtcaaggtatagccaacgcagttggaagaagaagggacagaactggtagaggtgtctttactgttagcactgtttcctccaatgtagttagtcagtccgaaggtctagttgaggacacgggcccaagtggagagggagaaagcgctgtttcttccgctgcatccgccgcaagtgctgctcaaacaggtccagaaagaacaggaagtgaaggtgcttcgacgagaggaggtgctggagcaggaagaggcttcggtgccggcgccggtgcaggagctgagtcaggcaaaggaggatacggttccggttctggagctggtgctggcgctggtgccggtgcttcaggcgagggaggcttcggtgaaggtcagggatacggtgctggtgctggtgcgggcgcttcggctggtgctggcgttggaagtggagcaggcgctggagccggatacggtgccggagcaggcgccggtgccggttttggcgtcggagccggagcaggtgccggagctggcgcaggatttggttccggtgcaggtgccggatctggtgcaggcgctggatatggtgccggaagagccggtggtcgtggacgtggaggtacgtcttc

SEQ ID NO: 598 - DNA, 557 bp, Artificial Sequence
  Description of Artificial Sequence: Synthetic polynucleotide
gaagacttagcaggtcaaaatactccatggtcatctactgagctggctgatgcttttatcaacgcgtttatgaatgaagccggtcgaactggtgcttttactgctgatcaactagacgacatgtctactattggagatacgataaagacagccatggataagatggccagatccaacaagagcagtaagggtaaattacaagcgctgaatatggctttcgcatcatctatggctgaaattgccgctgtggaacagggaggcctctcagtggatgccaaaactaacgccattgctgactccctcaatagcgctttttaccaaactacaggagctgctaaccctcagtttgtcaatgaaatcagatctcttataaatatgttcgctcaatcgtctgccaacgaggtttcttacggcggaggatacggcggtcaaagtgcaggcgctgccgcaagtgcagcagcagctggtggcggtggccagggtggctacggcaatctgggcggacaaggtgctggagctgcagctgcggcagccgcttcagcagcaggtacgtcttc

SEQ ID NO: 599 - DNA, 557 bp, Artificial Sequence
  Description of Artificial Sequence: Synthetic polynucleotide
gaagacttagcaggtcaaaacacgccttggtcctccaccgagcttgctgatgcctttattaacgctttcttaaacgaggctggacggactggtgcttttaccgccgatcaattagacgacatgtctacaatcggtgatactttgaaaacagccatggataagatggctaggtcaaacaaatcttctcaatcgaaattgcaagctctgaacatggctttcgcatctagtatggcagagattgctgctgtagaacaaggtggcttgagtgtggctgaaaaaactaacgccattgctgattcacttaatagtgcattttatcagacgaccggtgctgtaaatgtacaatttgtaaacgaaataagatccctcatttccatgtttgctcaagcttcggcaaatgaagtctcctatggaggcggatatggcggtggccaaggtggtcaaagtgctggtgctgcagcagctgcagcttccgcaggtgccggacagggcggatacggtggactaggtggacaaggagcaggttccgcagccgctgctgccgcaggtacgtcttc

SEQ ID NO: 600 - DNA, 458 bp, Artificial Sequence
  Description of Artificial Sequence: Synthetic polynucleotide
gaagacttagcaggtcaggccagatcaccttggtcagatactgcgaccgctgatgcttttattcaaaactttctggctgccgtctccggatccggtgctttcaccagcgatcaattggacgatatgtctactataggtgacaccattatgtctgctatggataagatggcaagatcgaacaagagttcacagcataaactgcaggccttgaacatggcattcgctagttctatggctgagatagccgcagttgagcagggtggcatgtccatggcagtcaagaccaatgcaattgtcgatggactaaactcggctttttatatgactactggtgccgccaaccctcaatttgtcaacgagatgcgatcgctgatttctatgatttcagctgcatcagctaacgaagtgtcatatggaggaggagcatctgccgctgctgccgcagcaggtacgtcttc

SEQ ID NO: 601 - DNA, 674 bp, Artificial Sequence
  Description of Artificial Sequence: Synthetic polynucleotide
gaagacttagcaggtattttcattgccggtcaagctaatactccatggtctgacactgctaccgccgatgcattcatccaaaatttcttgggtgcagtctcgggcagtggtgcttttactccagatcaactcgacgacatgagtaccgttggagatactatcatgtctgctatggataaaatggcacgcagtaacaaaagtagtaaatcaaagctccaagcacttaacatggcatttgccagttccatggctgagatcgcagccgtggagcaaggaggccaatccatggacgttaaaacaaatgctattgccaatgcacttgattccgcattttatatgacaactggtagtaccaatcaacagttcgttaatgagatgcgatcattgatcaatatgctgtcagccgccgctgttaatgaagtttcctacggtggaggagcatcagcggctgcagccaccgctggaagctacggacagggtcctagcggttacgctcaaggttcatccgctgcaagtgctgcagctccgtcaggttatgtcccctcccaaacaggacaatctggtctgggtgccgctgctgctgcagcagctgtagccccttccggatatggtccaagtcagcaaggtccatcaggtccgggtgcagctacagccgctgccgcaggtacgtcttc

SEQ ID NO: 602 - DNA, 461 bp, Artificial Sequence
  Description of Artificial Sequence: Synthetic polynucleotide
gaagacttagcaggtcagaatgttgctgattctccttggtctagcaatgagaaggctgattttttcattcgttctttcaacgaagtcatatccaggtcctcggcatttacttctcaacagatcgatgatatgagtagtattggcgaaacattaatcagctccatcgataacatggccaagaatggtagatccagcactaagaagctacaagccttgaatatggcgttcgcttcatcaatggcagagattgcaatcgcagaacaaggcggtcagagtattgatgttaaaacaaatgcaattattgacgcactaaacgaagcatttattcgtacttcgggttctgtcaacaacgaattcatctcggaaattcggcagctaattcttatgttcagtcaagtttcgatgaatgattccgcttccggtagcaccgctgccgcaaacgcaggcgcaggtacgtcttc

SEQ ID NO: 603 - DNA, 563 bp, Artificial Sequence
  Description of Artificial Sequence: Synthetic polynucleotide
gaagacttagcaggtgctaggggaattcacgtttcttcttataccccattcgcagacccatacacagctgagaactttgctcgcgctttcgttaataacattgttaactcaggtgagtttggtgctcaagacgcagccgactttgacgatattacgcagtcactcttgcaagctcaaaatttacacaaacgtcatgacagtaatgctaaggcaaaagctatgcaaatggcctttgcttcctctattgctgaactagttatcgcggaatcggaaggagcaaacattcaaaggcgtacatccacagtatctaactgtatgcgtaacgcaatgcaatcaacgaccggtggtgtggacgaagagtttatgcgtgaaattgaggacttgattcatctgttctcacaagaaagttttaacgaagtcgaaaactacggtcctggtacatattaccagtcgtctactacaggcggagctcctgtggtgaccgagtctgtcactgttaccgtagcaggtggcggacgtggcgctccagttaatcaaggaggacaagccccaggtacgtcttc

SEQ ID NO: 604 - DNA, 542 bp, Artificial Sequence
  Description of Artificial Sequence: Synthetic polynucleotide
gaagacttagcaggtggaggtccaactccctgggattcaccatcaatggccgagtcattcatgagtaacttcatgtctggaattgcttccagtggcgctttctctggcggacagatcggagatatgcaagatattacaggaaccatgcaggattctgtaaataagatggcctctactggaaggtcgtcaaaatctaaactccaggcaatgaatatggcattcgcatcgtctatggccgaaatcgcagctgcggaggcaggtggatcctctatggctgccaagactagtgctatcacaaatgccctaaggggtgctttcttgcaaacaacaggagtttctaatgagcagtttatcaacgaaattgctacgttgattaacctgatctctcaatccaacgtgaatacagtatcagcttcggcttccgcaggaggtggtggaggttacggcgcccctgcttatggtccttcatcttacggtccatcccaaggaccttcgtcagtgtcatccgttagcgtctcctcatcagctgcaggtacgtcttc

SEQ ID NO: 605 - DNA, 554 bp, Artificial Sequence
  Description of Artificial Sequence: Synthetic polynucleotide
gaagacttagcaggtagaggaattcatgtttcaattctttcaaatccgaatactgctatgaccttcgctcgtactttcgtctctaacattgctggatgtggcgaatttggatcgcagggtaccgaggatttcgatgacattatgcaatctcttattcaagctcagtccatgggaaagggtagacatgacaccaatgctaaggctaaggccatgcaaatggccctagccagctctattgctgaattgattgtagaagagtccggtggagtaaatatgcaacaaaaaaccaacgccgccattaacgctctgcgtaacgctttgcgttctacaagtggtaaggtagatgagggatttgtgagtgagattgtggaactcgtgaatttgttttcacaagaacagtttaacgaggtcgataccggatcatcacgtcaatactaccaatcctcgaccggtggtggccagggaggagctccaaccgtaactgaaactgttactgtatctgtcggaggaggtggaggtggtgctgcccagtccagtggaccaggtacgtcttc

SEQ ID NO: 606 - DNA, 512 bp, Artificial Sequence
  Description of Artificial Sequence: Synthetic polynucleotide
gaagacttagcaggttacccccaacagaactatcagcctggaattggcatagcccaagacgatccattacttgatgaaggaaccggtgagaatttcgcggatgttttcactcaaaccttggaaaactgtggtgcttttactcacgacgaggctcaggagtataaagaaattattcgtgtgctgacgaaagcattcggatcattcccggacctgcagaaggctccacctggtgttctgaaagctacagccgccggtttcgcttcagcggtggcggaacgaactgctgctgatgttgaccacggacagttgtttgcaaagacacgatgtgtaatccaggctttgagagaggcattcatcgttactacgggagttactaacccatattttatatccgaggtggaaagattgatcgaagttttctatattaccaagggtctacctcactctcctgtccagcaacctctagaagaaccacaaggtcaagtacaataccaacaacaaggtacgtcttc

SEQ ID NO: 607 - DNA, 563 bp, Artificial Sequence
  Description of Artificial Sequence: Synthetic polynucleotide
gaagacttagcaggtgcatcacctactttttctcgaagtccttgggctaaccctgctaaggcttcttcacttatgaactgtctcatcactaaaatcgcatcatcaaacgttctacctcaacaggaaaaagaagatcttgagtcaatcatggataccttgatgtctgctataaagggtgcctccgcaaaaggaaagtcatctggtgctcaattgcaggccattaatatggcagtcgcttctagtttggctgagatcgtcgtcgctgaagatgtaggtaaccaagcttcgatggctgtcaaaactcaggccctgtcgggagccctagagcagtgtttccagaccgtgatgggaacggttgaccgaaagttcattaaggagattaatgacttgatcagtatgtttgctagacaagccgctacggaggctaatgaaattcaggaccagggcggtttttacgccgccggtagttcggactctactagcttccaggcaacgtctcgcactttacagggatcttcacaaacgacaggaggattcggaggagcatatccaggtacgtcttc

SEQ ID NO: 608 - DNA, 524 bp, Artificial Sequence
  Description of Artificial Sequence: Synthetic polynucleotide
gaagacttagcaggtcagtccaaccctgttaacgatgatccgtatggctttaatgaaaccgagaagaagttttctgacgttttcgtggataatgtcattaattcagatgccttcactctaatgggtgaaaacgacattgaagaggtgacgaacattttgctgacgtccatacaactccttaagaagtctcaggatggagatgcgaatcaaaaaaagaccttgatggtagcttttgcgtctagtatggccgaacttattttggatagatgtgacactacattaggtatcgaacataagaccgagattataacaaatgccttgaagaatgcttacctacaaaccacaggaaagcccaataagcctctgatcaaggaggtcaggttccttgttgcactgtttttgacactggagtccccaggttttttagatcctttgtggaatccatacggaagaaatccagctttcggactgccaccatcctatggagttccactatacccagcgcccccacaaggtacgtcttc

SEQ ID NO: 609 - DNA, 470 bp, Artificial Sequence
  Description of Artificial Sequence: Synthetic polynucleotide
gaagacttagcaggtcttggacagtccccgtggaaggacgcctcaatagctgagtcattcatgaataacttctctaacgcgcttgcccgctccggagctttttcgagtgaccagatggacgacatcatgtctatttgtgactcaattcagtctggaattgtcagaatggatcggtcaggtaaaacttctgctaataagttgcaagctatgaatatggcttttgcctccgctgtggcagaaatcgcaattgccgagggtggaggacaatctgctcaagtcaagacaaacgctgtcgcagacgctttagccagtgcttttctacaaacaaccggagtggtaaacacacagtttatcaacgaaataagaactttaatctctatgtttgctcaggctaacgttatcgattcctcttcgggtagtgtttccgcaagcgctggtggagctggtcaaggaggagcaggtacgtcttc

SEQ ID NO: 610 - DNA, 623 bp, Artificial Sequence
  Description of Artificial Sequence: Synthetic polynucleotide
gaagacttagcaggtttcggccaggcagctaccccatgggagaacactgccttggcggaagcctttatcaataagtttttggaatcaattggacaaactggaaccttttcggctagccagcaggacgacatggcgacgattggagacactcttaagaccgccatggaaaaaatggctcaatctaggaaatcctcgaagtctaaattacaagctcttaatatggctttcgcttcatctatggctgaaattgcagtggctgaacagggaggtttgtcaattcaggcaaaaacggaagcaatagcttcagctctgtcgagcgcttttttgcaaacaacgggtgtgattaattaccaattcgttaacgagatcaaatcgttgatatacatgatcgcccaagctagcactaacgaggtcggttcttccgccgcgtcggctggaggtggatccggtggaggtagctacggacagggttcctacgtatctgcttctgctgcgggtacatacggttctgctcctcaacagggcggttacgcacctgcacagggtccttcccaacaaggacctgtgtcccaaggtccatatggtccgagtgcctctgttgccgccgcagcaggtacgtcttc

SEQ ID NO: 611 - DNA, 407 bp, Artificial Sequence
  Description of Artificial Sequence: Synthetic polynucleotide
gaagacttagcaggtcaacaaatttggacaaatcaggctgctgtaatggcaatgaccaacaattttgttggatgtgctagccagtccggcatgctcagtgctgatcaaatggatgacatggctatgatggcagacaccattaacatgcaagcaacgaggatgggtcctaatgctcccagacacaaattgaaggcactcaactctgctatggccgcttctattgctgaagtcgctgctagttccccaccacaatcctattccgccgtgttgaatgctattggatcctgcctgagggactcaatgatgcaggcgactggtgcagttgatgaaattttcacaaccgaagtgatgaagatggtgaacctattcgctatggataacgctaactcggtatcaggtacgtcttc

SEQ ID NO: 612 - DNA, 545 bp, Artificial Sequence
  Description of Artificial Sequence: Synthetic polynucleotide
gaagacttagcaggtcagaagatttggactaacccagatgccgcaatggccatgacgaacaatttagtccaatgcgctggtcgtagcggagcattgactgccgatcagatggacgacttgggtatggtttctgactctgtaaattcccaagtaaggaagatgggagctaatgctccacctcataaaattaaagccatgagtaccgctgttgccgctggtgttgcagaagtcgttgcttcttccccaccccaatcctattctgccgttttaaacactattggaggatgtttacgagaatccatgatgcaggttacgggttcagttgataacactttcactactgagatgatgcaaatggtcaacatgtttgctgccgataacgccaacgaagtgtcagctagtgcttccggcagtggagcctcctatgccactggtacctccagcgctgtgtcaacttcgcaggctacaggatattctacagctggtggatacggcacagcagccggcgccggagcaggagctgctgctgccgcaggtacgtcttc

SEQ ID NO: 613 - DNA, 566 bp, Artificial Sequence
  Description of Artificial Sequence: Synthetic polynucleotide
gaagacttagcaggtgctgcatctagtagtagcactatcatcacaacaaaaagcgcttccgctagcgctgccgcagacgccagtgctgctgctactgcctccgctgccagcagatctagtgccaatgcagcagcatcagcgtttgctcagtctttttcctccattctgttagagagtggatacttctgtagtatctttggatcatccatttcatcttcttatgcagccgccattgcttctgcagcatcacgcgcagccgctgagtcaaatggctacacaactcacgcttatgcgtgtgcaaaagctgtagcttctgccgtagaacgtgttacttctggagccgatgcttatgcctatgcccaagcaatttccgatgctctatctcacgcgctcctctacactggcagactcaacactgctaatgctaactcattggcaagtgcgtttgcttacgctttcgctaatgccgctgcacaagcaagtgcatcatcagcttctgctggagccgcctctgctagtggtgcggccagtgcctcgggtgcaggatccgcttcaggtacgtcttc

SEQ ID NO: 614 - DNA, 566 bp, Artificial Sequence
  Description of Artificial Sequence: Synthetic polynucleotide
gaagacttagcaggtgcagcttcaagttcatcgacaatcatcaccacaaaatccgccagtgccccagctgctgctgatgctagtgctgccgccacctcatctgcagcttctagatcctctgctaacgcagccgcatccgcatttgcgcaatcatttagtagcatcttgctcgaatcaggatattttggttctatttttggatctagtatatcttcaagctacgcagctgctatcgcttctgccgccagtcgtgctgctgcagaatccaatggatacacaacacacgcatacgcatgcgcaaaggctgtagcatcagctgttgaacgcgtgacttcaggtgcagacgcatatgcatatgcacaggctatttctgatgcgttgtcccatgcattgttgtacacgggtcgacttaataccgccaacgcaaactctctcgcctctgcgtttgcttatgcttttgcaaacgccgctgcgcaggccagtgcgagttcagcctccgctggagctgcatctgcctccggtgcagcatctgcttcaggagctggatccgcttcaggtacgtcttc

SEQ ID NO: 615 - DNA, 566 bp, Artificial Sequence
  Description of Artificial Sequence: Synthetic polynucleotide
gaagacttagcaggtgcagcttcgtcctctagtaccattataactactaaaagtgctagtgcttccgcggcagctgatgcttctgctgcagctactgcatccgcggccagcagatcctctgcaaatgctgcagcaagtgcatttgctcaaagattctcctctattctgctggagtcgggatacttctgttctattttcggttcttccatttctagttcttatgcggctgccattgcttctgcagcgtcgagagctgcagctgaatccaatggatacactactcatgcttacgcatgtgcaaaggcagttgcaagtgccgtcgaaagagtcacctccggtgccgatgcctacgcttacgcacaagccatctctggtgcactctcacacgctttactttatacgggaagattgaatacggcaaacgctaactctttggcttcagcttttgcttacgctttcgctaacgctgcagctcaggccagtgctagttcggcttccgcaggtgcagcctcagcctcaggagctgctagcgcctctggagctggtagcgcttcaggtacgtcttc

SEQ ID NO: 616 - DNA, 566 bp, Artificial Sequence
  Description of Artificial Sequence: Synthetic polynucleotide
gaagacttagcaggtgcagcttcatcatcttcaactatcattacaactaaatcggcttcagcctcggctgctgcagatgcgtcagctgcggcgactgcgtctgcagctagtaggtcctctgcgaacgcagccgcaagtgcctttgctcaatcgttctcatccatccttttggaatccggatacttctgctctattttcggatcgtcaatctcctcaagttacgctgcagctatcgcctccgcagccagtagggctgctgccgaaagtaatggttacacgacccacgcatatgcttgtgcaaaggcagttgcctccgctgttgaaagagttacatcgggagccgatgcatacgcctatgctcaggctatttccgatgcattatcccatgcactattgtatacaggtagattgaataccgcaaacgccaatagtttggcttcggcttttgcatacgctttcgcaaatgcagcagcccaagcttctgcttcatcagcttcagctggcgccgctagtgcctcaggagctgctagtgcttccggagcaggttccgcctcaggtacgtcttc

SEQ ID NO: 617 - DNA, 566 bp, Artificial Sequence
  Description of Artificial Sequence: Synthetic polynucleotide
gaagacttagcaggtgctgcatcttccagttcgactataataaccaccaagtcagccagtgcatcagcagctgcagatgcttcagctgctgctaccgcctctgctgcatctcgatcctccgccaatgcagcggctagtgcctttgcgcaatctttctcttccatcttgctagagtctggttatttttgttcgatttttggatcatccatatcttcatcatatgcagccgcgatcgcgtctgctgcaagtagggctgccgcagaaagtaatggttacacgacccatgcatatgcctgtgcaaaagctgtagctagtgcagttgaaagagtaacctcaggcgctgacgcttacgcctatgcccaagctattagcggcgcacttagtcatgctctgttgtacactggtcggttaaatacagctaacgctaactctttagccagtgccttcgcatacgctttcgcaaacgctgccgcccaggcctcagcttcttctgcctccgcaggtgcagcatcagcttcaggagcagctagcgcctcaggtgcaggttcagcctcaggtacgtcttc

SEQ ID NO: 618 - DNA, 566 bp, Artificial Sequence
  Description of Artificial Sequence: Synthetic polynucleotide
gaagacttagcaggtgcagcatcatctagttctactatcataactactaaatcggctagcgccagtgctgctgcagacgcatcagcagctgcaactagttcggccgcctccaggtctagcgccaatgcggccgcttctgcctttgctcaaagtttttcctctattttgctggaaagtggatatttcggttccattttcggttcttctatttccagcagttatgccgccgcaattgctagtgctgcctcgcgagcggctgcggagagtaatggatatactactcacgcctatgcctgtgccaaagcagtcgctagtgcagtagaaagagttacctcaggtgccgatgcatatgcctatgctcaggcaatttcgggagctctttcacatgccttgttgtacaccggtagattgaatacggctaatgctaactcattggcatcagacttcgcttacgcattcgcaaacgcagccgctcaagctaccgcctcttccgcctctgcaggagcagcttcggcctccggtgctgcttctgcatctggtgccgcatccgcatcaggtacgtcttc

SEQ ID NO: 619 - DNA, 566 bp, Artificial Sequence
  Description of Artificial Sequence: Synthetic polynucleotide
gaagacttagcaggtgcagctagttcctcttcaactataattactactaaatcagcatctgcaagcgctgccgccgacgcatcggcggcagctacagcatcagccgcgtctagatccagtgcaaacgcggctgctagtgcctttgcacaaagctttagttccatattgttggagagcggttatttcggttctatttttggatcttccatttctagctcctatgcagccgcgattgcttcagctgcttctagagctgctgctgaatccaacggatacacaacacatgcttatgcttgtgcaaaggctgtcgcttctgccgtcgagagagtcaccagcggagccgatgcctatgcctacgctcaagcgatctccggtgccttgtcttatgcactcctttacacaggtagactgaatactgctaacgcaaactcattggctagtagctttgcttacgcttttgcaaacgctgcagctcaggcttctgctagcagtgcgtccgctggagcagcatccgcttctggtgcggcttctgcctccggagcagcttccgcttcaggtacgtcttc

SEQ ID NO: 620 - DNA, 530 bp, Artificial Sequence
  Description of Artificial Sequence: Synthetic polynucleotide
gaagacttagcaggtgccgctgctacatcttcatcgaccagcggagcctcggcctctagtatttcgtccacaactgcctcaagttcttctacaggagcaagttcagctgccgctggagctagtcacggagcagcttcggcgggtggagcatttgattttacgagagctctattttctgaactgctagaatctaagatattttccgccaccacggcaaactttcatagttccacaacggcttctgaaactctttacgccaccattctgaagtgccttagggaattacacttcaggtacgacgaatgcttgcaaggtgcaactgaagtggtgagtgatttgtctgtagtatccgttggttctggagttcacaactacgctagagttattgcagctttctttgaacgcttctttcgaaagcacgacatcccattgtccgcaaactatgcttccagagttgcacagtatttaatttcagctatgggcagttcggtagcttccgcagacgcttcgtcgtcatcaggtacgtcttc

SEQ ID NO: 621 - DNA, 530 bp, Artificial Sequence
  Description of Artificial Sequence: Synthetic polynucleotide
gaagacttagcaggtgcggctgccactagttcctctacttctggtgcatcagccagcagcatctcctcaacaactgcttcctctagtagtactggagctagttctgctgcggctggtgcctcgcacggtgccgcctcagctggtggagcgttcgatttcacacgcgcattgtttagcgaactgttggaaagtaaaattttctcagctaccaccgcgaacttccattcttcaacgactgccagtgagactttgtatgctacgatactgaagtgtttgcgtgagttgcacttcagatacgatgaatgtctgcagggagcaaccgaagttgttagtgatttgtctgtagtgagtgtaggatctggagtccacaactatgctcaagttatcgctgcctttttcgaaagattcttcaggaaacacgatattcctctgtcggcaaattatgcctctagagtagcccagtatctcattagcgctatgggctcaagcgttgcaagcgcagatgcttcgtcctcatcaggtacgtcttc

SEQ ID NO: 622 - DNA, 530 bp, Artificial Sequence
  Description of Artificial Sequence: Synthetic polynucleotide
gaagacttagcaggtgcagcggctacgtccagcagcacatctggagcctcagcatcttccatttcatcaaccactgcatcaagctcaagtacgggagcttcctccgctgcagctggcgccagtcacggtgctgcatccgccggtggcgcattcgattttacaagagctttattttcagaactgctggaatcaaaaattttttctgccactaccgcgaattttcattcgtccaccactgcttctgagacactttacgccaccatattaaaatgtttgcgtgaattgcactttcgatatgatgaatgcctacaaggagctacagaggttgtatcggatctgtctgtcgtgtccgttggaagcggtgttcataactacgcacgcgttatcgccgctttcttcgaaaggttttttagaaagcacgacatcccactgtcagctaactatgcttctagggttgctcaatacctgatctcagcaatgggatctagcgtcgctagtgctgatgcgtcctcctcttcaggtacgtcttc

SEQ ID NO: 623 - DNA, 530 bp, Artificial Sequence
  Description of Artificial Sequence: Synthetic polynucleotide
gaagacttagcaggtgcagctgcaacaagttcatcgacttctggcgctagcgcttcatcaatatcttcgactacagctagcagtagttccacaggtgcttcatcggcagcagcaggagcaagtcatggtgccgcttcggcgggaggagcttttgatttcacaagagccctattttctgagctactcgaatctaaaatcttctccgctacaaccgctaatttccactcatcaactacggcctcagaaacattgtatgcgactattcttaaatgcctaagggagttacactttcgttatgatgaatgcttgcaaggagcgactgaggtagtgagtgacctctctgtagtatctgtcggcagtggtgttcataactatgccagggtaatcgccgcattcttcgagcgattttttagaaaacacgatataccacttagtgctaattacgcctcccgggtggcacagtacttgatttctgcaatgggttctagcgttgcttctgcagatgcctcttccagttcaggtacgtcttc

SEQ ID NO: 624 - DNA, 530 bp, Artificial Sequence
  Description of Artificial Sequence: Synthetic polynucleotide
gaagacttagcaggtgcagccgccacaagtagctccacatctggtgcctcagcttcatctatttcctcaactacagccagctcttccagtactggagcttctagcgcagcagctggtgcttcacatggagcagcttccgctggaggtgctttcgacttcacaagagccttgttctctgagctgctggagtcgaaaatcttctctgcaacaactgctaatttccattcgtcaactactgctagtgaaactctatatgctacaatcctaaagtgtcttagggaattacattttagatatgatgagtgcttacagggagcgaccgaggtggtcagcgatttatctgttgtctcagtcggaagtggtgttcataattacgctagagtgatagcagcatttttcgagagattcttcagaaagcatgatatcccgcttagcgccaattacgcgtctagagttgcccaatacctgatatctgccatgggttcatctgtagcttctgcagatgcttcatcatcatcaggtacgtcttc

SEQ ID NO: 625 - DNA, 560 bp, Artificial Sequence
  Description of Artificial Sequence: Synthetic polynucleotide
gaagacttagcaggtgctagttcgacaacgaccgccacatcggaatcaggaattactgcttcctcagttgcaactggagcagccgctgccatttctaagactgcagccggtagtagttctattacttacctagctcgctcgttttccagatcattagtgagttatttattgcaaagcgcagaattccattcggttttttacagtggaatttcgtctggtattgcttcgcatatagcctccaccgccggaacatctactgcagagtcactggacctcgctagcctcaaatctgtcatagcaacagcctgcggaaaagctatggctgctacaaattccgagggaggtcctcatgctttcgctaatagtctaggatccgccataaccgcggttttgatcgaaaacgctattttaacaagcgagaattacgattattttgcaaaagaattcgcccacatcttttcaatttctgcatcgaaggtagtatcagctactagtgcaaagtctgcaagtgaggccacaagtgcttcttggacggctgcatctcgtacaggtacgtcttc

SEQ ID NO: 626 - DNA, 560 bp, Artificial Sequence
  Description of Artificial Sequence: Synthetic polynucleotide
gaagacttagcaggtgctagctccaccactaccgctacctctgaatccggaattacagcttcatcggttgccacaggagctgctgcagccataagtaaaactgcagcaggatcttctagcatcacctatttggccagatcatttagtaggtcattggtgagttatttgttacaaagtgccgaattccactccgttttctactctggaattagttcaggtattgccagtcatattgcttcgacagcaggtacgtctacggctgaatctttggacctggcttccctgaagtccgtgatagcaactgcctgtggtaaagctatggcggctactaactctgatggtggaccacacgcctttgccaattccctgggttccgccattacggccgttttgattgaaaacgctattcttacgtcagagaattatgattattttgctaaagaattcgcacacatattctccatttctgcatctaaggtagtaagtgccacctccgcaaaatctgcaagtgaagccaccagtgcttcgtggacagctgcgtcacgtacaggtacgtcttc

SEQ ID NO: 627 - DNA, 560 bp, Artificial Sequence
  Description of Artificial Sequence: Synthetic polynucleotide
gaagacttagcaggtgctagctctactaccactgccaccagcgaatcaggcattacagctagcagtgtcgcgactggagcagctgccgcaatttccaagacagctgctggtagttcgtctataacctatctagcaaggtccttttcgagatcactagtttcctacttgctgcaaagtgccgaattccattccgttttttattccggaatcagctctggtatcgctagtcacatagcttccacggctggtacttctacggctgaatcgttggatttagccagtctcaagtcagtgattgccacagcttgtggtaaggccatggccgcaactaatagtgagggtggtccgcatgcctttgcaaattcactaggaagcgctattactgctgttttgatcgagaatgccattttgacctcagaaaactacgattacttcgcaaaggagtttgcccatattttcagtatttctgctagtaaagtcgtgagtgctacatctgctaagtccgcttctgaagccacatcagctagttggacagcagcttctagaacaggtacgtcttc

SEQ ID NO: 628 - DNA, 449 bp, Artificial Sequence
  Description of Artificial Sequence: Synthetic polynucleotide
gaagacttagcaggtgctggcgctggagctggagtaggtgtgggcggtgcaggcggttacggtcagggttacggtgctggagctggagcaggagctggagctggagctggtgcaggtggagctggaggttacggccagggttatggagctggtgcagcagctgctgctggagctggtgctggtgcagctggtggctacggaggaggttcaggagcgggtgctggtggtgctggaggttatggtcaaggatacggtgcaggttctggagccggtgcgggagccgctgcagcggccggtgcatctgctggagccgctggtggctatggtggaggagctggagttggtgctggagctggcgctggtgctgcaggtggttacggccaatcatacggatcaggtgctggagcaggtgcaggagcaggtgctgctgctgccgcaggtacgtcttc

SEQ ID NO: 629 - DNA, 389 bp, Artificial Sequence
  Description of Artificial Sequence: Synthetic polynucleotide
gaagacttagcaggtggagctggtggcggtggacaaggcggacttggatcgggaggagccggacaaggttacggagctggtctaggaggtcagggtggagcctcagccgccgccgctgcagctggtggtcaaggaggtcaaggtggtcagggtggatacggtggattaggatctcagggagcaggtggagctggtcaactgggatatggtgcgggccaggaatcggctgccgcagcagccgctgccgcaggcggtgcaggtggtggtggtcagggaggtttgggtgctggcggcgctggtcaaggttatggagccgcaggtttgggtggacaaggaggagccggccaaggaggtggatctggagcagctgccgctgcaggtacgtcttc

SEQ ID NO: 630 - DNA, 638 bp, Artificial Sequence
  Description of Artificial Sequence: Synthetic polynucleotide
gaagacttagcaggtggttacggaccaggttcaggtcaacagggaccgtcacagcaaggaccaggacaacagggaccaggaggccagggcccatatggaccaggtgcatctgcagctgctgctgcggctggcggttatggtccgggatcgggtcagcaaggtcctggtggacagggaccttacggacctggatcttctgcagcagctgctgcagcaggcggcaatggcccaggttctggacagcaaggtgctggacaacaaggcccaggtcagcagggacctggagcatccgccgcggcagctgctgcaggtggttacggacctggttctggacaacagggtcctggtcaacagggacctggaggtcaaggtccttatggtcccggtgcatccgcagcagctgctgctgctggcggttacggaccgggatctggtcaaggtcctggccagcaaggcccaggaggacaaggtccctatggtccaggtgcatcagctgctgctgcagcagcaggtggttatggtccaggatcaggtcaacaaggtccaggtcagcaaggtccaggtcaacaaggacctggtggtcagggtccatatggcccgggagctagtgccgctgctgctgctgcaggtacgtcttc

SEQ ID NO: 631 - DNA, 743 bp, Artificial Sequence
  Description of Artificial Sequence: Synthetic polynucleotide
gaagacttagcaggtggatacggaccaggctatggacaacagggtcccggccagcaaggtccgggtggacaaggaccttatggtcctggtgcttcagctgcaagtgctgcatctggtggatatggtcctggttcaggacaacaaggcccaggtcaacaaggaccaggtggtcaaggtccatatggccctggagccagtgccgccgccgctgcagcaggtggatacggaccaggttcaggtcaacaaggtcctggacaacaaggtcccggtcaacaaggccctggacagcaaggaccaggcggacaaggcccttatggaccgggtgcttctgcagctgctgccgccgccggtggttatggtccaggatctggtcaacagggaccaggccaacagggaccaggtcagcaaggtccaggacagcaaggacctggacagcagggtcctggacagcaaggtccaggacaacagggacctggtcagcaaggcccgggccaacaaggtcctggtggacaaggtgcttacggacctggtgcctctgctgccgctggagccgcaggcggatacggtcctggatccggtcagcaaggccctggtcaacaaggcccaggtcagcaaggaccgggtcaacaaggacctggccagcagggccctggtcagcaaggcccaggacagcagggacctggtcaacaaggtccttatggtcccggagcgtctgctgccgcagctgcagcaggtacgtcttc

SEQ ID NO: 632 - DNA, 719 bp, Artificial Sequence
  Description of Artificial Sequence: Synthetic polynucleotide
gaagacttagcaggttcgggacctggtggttatggtccagagaatcagggcccctcaggtccgggtggttacggaccgggtggctccggatcctctgccgccgccgccgcagcggccgcttccggacctggcggatatggtcctggctcacaaggtccttcaggaccgggcggtagtggaggttatggtccaggcagtcaaggagcttcaggaccaggtggtcccggtgctagtgcagctgctgcagcggccgcagccgctgcatctggtccaggtggttacggacctggaagtcagggtcctagcggtcctggagcttatggtcctggtggtccaggttcttcagccgctgctgctgccgctgctgcatctggtcctggaggatatggtccaggctcccaaggaccttctggtcctggtgtctatggcccaggaggaccaggatcatccgctgcagctgcagctgccgccggaagtggccctggtggctatggtccagaaaatcagggaccttctggtccaggcggttatggacctggaggttctggatcatctgccgccgcagctgccgctgctgcctcaggaccgggtggatatggacctggatcccaaggcccgagtggtccaggaggatcaggaggatatggaccaggatcccagggaggttcaggaccaggagcttctgcagctgctgccgcagcggctgcaggtacgtcttc

SEQ ID NO: 633 - DNA, 602 bp, Artificial Sequence
  Description of Artificial Sequence: Synthetic polynucleotide
gaagacttagcaggttcagcaacatccagtactacaaccactacgaccgtgtcgaagtccgcagccgcagcagcggcagcagcagctgctgcttcatcagcttcctctgcctcgcgtgattctgataggtcaagcactgcagcagaggcttatgctagttcgtctgcctacgctagttctaacttcgagaactacttagcttcagatttgagcaattcagatgaattcgagagtgtctatggctcgctgtattctagtgctgacgctgcgtcgtacgcacgaagtagcgctgagtacgcgtcgaatactttaggattgtccaaagaaacatcgtacgccttagcatccgctgcggctaaagctgtttctgaatccggcagtggttcatcaagttacgctagagcttacgcagttgctaaatcaagcgccgtagtgttacaaaactcgggtgtacttagctcttcaaactcccgatcactcagtagtgccttcgccaaagcttttgcaagttcctccgcatcttcctatgcttcatatcaatcgcgaaacacaggcacatcaagagcaagttcagccggttccggagctgcaggtacgtcttc

SEQ ID NO: 634 - DNA, 602 bp, Artificial Sequence
  Description of Artificial Sequence: Synthetic polynucleotide
gaagacttagcaggttctgcaacctcctcaaccactacgactactaccgtatctaaatcagctgctgcagccgctgctgctgccgctgcagctagtagcgcatcaagcgcttcacgagattcggacagatcatcgactgctgcggaggcttacgctagttcgtctgcttatgcttcaagtaattttgagaactatttagcctcagacctcagcaactctgatgaattcgagtccgtctatggtagcgtatattctagcagtgacgccgcttcttacgccagatcttctgccggctatgcaagtaacacattgggtttgtccaaagaaacaagttacgctctagcctcggcggccgcaaaagccgtttccgaatctggttcgggatctagttcatacgctagagcatatgctgttgctaagtcatccgcagctgtgctgcaaaattcaggtgttctttcttctagcaatagccgttccttatcaagtgcctttgctaaagcctttgcttcttcgtctgcatcttcctatgcttcttaccagagtaggaataccggaacatctagagcatctagtgccggaagtggagccgcaggtacgtcttc

SEQ ID NO: 635 - DNA, 602 bp, Artificial Sequence
  Description of Artificial Sequence: Synthetic polynucleotide
gaagacttagcaggtagtgcaacaagcagcaccaccactacaactactgtctcaaagtcagctgcggcggccgccgctgccgcagcggctgcatctagtgcctcgtcggcatctagggactccgataggtctagtacaaccgctgaggcgtatgcgtcgtcctcagcttatgcttcatccaactttgaaaattacttggcttccgatctgtctaacagtgatgaattcgaatcagtgtatggtagtgtgtattcctcatctgatgcagcatcgtacgctcgtagcagcgcaggttacgcttctaatacccttggactctccaaggaaacctcttacgctttggctagtgcagctgctaaggcggttagtgagtccggttccggatcgagttcctatgctcgagcttacgctgtagccaaatcttccgcagttgtcttgcagaacagtggagtactctcatctagcaactccagatcgctgtcaagcgcattcgctaaggctttcgcttcatcatctgcctcgagttacgcctcttacaagtctagaaacactggtacttctcgcgcgtcaagtgcaggatcgggcgccgcaggtacgtcttc

SEQ ID NO: 636 - DNA, 602 bp, Artificial Sequence
  Description of Artificial Sequence: Synthetic polynucleotide
gaagacttagcaggttccgctactagttcaacaactaccactactactgttagtaagtctgcagctgctgcagccgctgcagcagctgccgcctcatctgcctcgtcagcctccagagattccgatagatcttcaacggcagcggaagcttacgcttcttcctcagcatatgcgtcaagcaatttcgaaaactatttggcttctgatctgtcaaattcagatgagtttgaatctgtctatggatcactctactctagttcagacgcagcatcttatgctagatcaagcgccggatatgcttcaaacaccctcggtctttctaaagaaacttcctacgctttggccagtgctgcagcaaaagcagtttcagagtccggtagtggtagttccagctatgccagggcctacgctgtggcaaaatcttcagcagtcgtattacaaaatagtggcgttctgtcaagctcaaacagtagatctctatccagtgcctttgcgaaagcctttgcttcttcatcagccagttcttacgctagttataaatctagaaataccggtacatctagggcatcctcagccggttcaggagccgcaggtacgtcttc

SEQ ID NO: 637 - DNA, 602 bp, Artificial Sequence
  Description of Artificial Sequence: Synthetic polynucleotide
gaagacttagcaggttcggcgacaagttcaactacgaccacaacaaccgtgtcgaagtctgctgcagcggccgcagcagcagctgcagctgcttcgagcgcatctagcgctagacgcgactctgacagatcttcctctaccgctgaggcttatgcttcttcgtctgcttacacctctagtaactttgaaaactacctggcatctgatctatcctcaagtgatgaattcgaatctgtctacggttctctttattcctcttcagacgctgctagctatgctcgttccagtgccgagtacgccagtaataccttgggactatccaaagaaacttcatatgctctggcatcagccgcagcaaaggctgtatcagaaagcggtagtggatccagctcgtatgcacgagcttacgccgtcgctaaatctagtgcagtagtacttcaaaattctggcgtactgtcgagcagtaattctaggtctttgtcctctgcattcgctaaagcatttgcttcctcatctgcttcttcctacgcaagctacaagagtaggaatactggcacatctagagctagttctgccggttcaggtgccgcaggtacgtcttc

SEQ ID NO: 638 - DNA, 602 bp, Artificial Sequence
  Description of Artificial Sequence: Synthetic polynucleotide
gaagacttagcaggttcagccacctctagtactacaactactactactgtatcaaagtctgctgcagctgcagcagctgccgccgctgccgcttcgagtgcatcctctgccagccgcgacagcgacagatcctcaaccgcggcagaagcttatgcatcatcctcggcctatgcctctagcaatttcgaaaattatctagcctcagatttgtctaattctgacgaatttgagagtgtgtacggttcgttgtacagctcagcagacgctgcatcctacgctagctcctcaagtgaatatgcctccaatactttaggtctttcaaaggagacatcctatgcattggctagcgctgctgctaaggcggtttcagaaagcggttctggatcttccagttacgctagagcctacgctgtagcaaagagttctgccgttgttttaagaaacagtggtgtgttaagtagcagcaactcaagatcgctgtcatccgcgtttgccaaagccttcgcctctagttccgcttcttcatatgcttcttacaaaagtagaaacaccggaacctcacgtgctagctcggccggcagtggtgcagcaggtacgtcttc

SEQ ID NO: 639 - DNA, 602 bp, Artificial Sequence
  Description of Artificial Sequence: Synthetic polynucleotide
gaagacttagcaggtagcgctacatcttcgacaacaactacaactaccgttagcaaaagtgcagccgctgctgctgccgctgcagcagctgcatcctctgcaagtagtgccagaagagattccgacaggtcatcgagtaccgcagaagcttacgcctcctcatcggcgtacactagcagtaacttcgaaaactacttggcttctgatctaagttcttcagacgagttcgagtctgtttacggaagtctgtattcttcttctgatgctgcttcctacgcaagatcatctgcagagtatgcttctaacactttgggcctgtccaaagagacgtcctacgctctggcaagcgccgctgcgaaggcagtttcggaaagcggttctggttcttctagctatgccagggcatacgctgttgctaagtcatctgccgtggttttgcagaattccggtgtcttgagctcctctaattctagatccttatcttctgctttcgcaaaagctttcgcctcttcatcagcttcatcctatgcttcttctaagagcagaaacactggaacttctagagctagtagtgcaggtagtggagccgcaggtacgtcttc

SEQ ID NO: 640 - DNA, 533 bp, Artificial Sequence
  Description of Artificial Sequence: Synthetic polynucleotide
gaagacttagcaggtagtgccagatcatctagcgctgctgcggccagcgccgctgctttctcatctttaagtagagccttaatttatcgccttcagcaaaaccaagactttatatacaccttcaactctattgaaacgtccgatgcagcaagggctataacatactcttctgctctggcagccgctaacgctatgggtgcaggctcgtccgcttcccaggctgtagccttcgctgcagctaaagccgctgaaggtgtccctataagaagctcttcatacgcttatgctgaagccatcactaacgcaattactcctcattttttagccctgcatctagtgaatagtgctaacgtcgatgcttttgcctctgactttacttcctcatttgcaagtgccacggcgtccgccgcgagcgcttcagcagctgctagttccgcagcatccgctgctgcagccgcaactgcatcatccagttctaccagtacatcaacaaaaactactagttcggccgcagcagcagcaggtacgtcttc

SEQ ID NO: 641 - DNA, 548 bp, Artificial Sequence
  Description of Artificial Sequence: Synthetic polynucleotide
gaagacttagcaggttctgccatttctagcagtgccgctgcagcgagtgcagctgccttttcttctagtctctctcgagccttgatttatagattgcaacagaaccaagatttcatttatacatttaacagcattgaaacctcagacgccgctagggctatcacctatagttctgcactcgctgccgcaaatgctatcggtgctggtagtagcgcatcccaggcggtggcctttgctgctgccaaggctgccgaaggagtaccaataagaagtagctcctacgcctatgctgaggctattacaaatgcaataaccccgcactttcttgcttcccacctggttaatagcgccaacgttgatgcttttgcgtctgattttacaagctcgttcgcatctgcaactgcctcggcagcctcagcatctgcagctgcagcctcatcagctgctagcgctgcatccgctgctactacaaccgcttcctcctctacatcaacttctactacgacaacctcttcgacagcagccgctgccgccgcaggtacgtcttc

SEQ ID NO: 642 - DNA, 548 bp, Artificial Sequence
  Description of Artificial Sequence: Synthetic polynucleotide
gaagacttagcaggtgcagctgccagctccagagctagagcacaagctgcagccgcatcctctgctgctgcgtcggcggcagcagcttccagtgcatttgcagaagaactggcatttttgctgtggcaatctcaggacttcatcagtgcttttggatctactgccagttctagcgaagcaaccgcattagctcgttcctcagtaatggcagctgcaagagccgttggagtagctgaggctgcttccgctattgcaagtgctgcggctagtgcagcagcaggtgtctcacacggatcgtccgctgttgcttacgctagagcaattgcctccgccgttgctagagcttttgcccaatttggtatattaactctcagtaatgccgctgcctttggacgccaattcgctagatcctttagctctagcgcagctgcttcggcagcttcagctgcatctgcttcggctgcgagcgcaaaaagcgctgctgctgccgctgcttcttcatccacgacttcaacgagtactacaaccacttccacaggtacgtcttc

SEQ ID NO: 643 - DNA, 548 bp, Artificial Sequence
  Description of Artificial Sequence: Synthetic polynucleotide
gaagacttagcaggtgcagctgctagttcaagaactcgtgcccaggcagctgccgcgagttccgccgccgcaagtgcagctgctgcatcaagtgcattcgcagaggagttaacatttttgttacgacaaagcccgaactttatctcagcctttggttcaacggcttcaagttctgaagctacagctctggccagaagttccgcaatcgctgccgctcgagctgttggagttgcaggagctgcttctgccatagcttctgcagcagctagtgcagcggctggtgtgtcccatggttcttcagctgctgcctatgctagagccattgcttttgccgttgctcaagcttttgccccgtttggaatcctcacattggccaaagctgccgcttttgcttctcaattcgcgcgatcattttcttctagtgctgcggcgtctgctgcttcagccgcttctgcgagtgctgcctcggcgaagtcagccgctgctgcagctgcctcatcatcaactacatccacaagcaccactacaacatccacaggtacgtcttc

SEQ ID NO: 644 - DNA, 548 bp, Artificial Sequence
  Description of Artificial Sequence: Synthetic polynucleotide
gaagacttagcaggtgctgcggcctcctcgagagctcgagcagaagcagctgcggcatctagcgctgctgcttctgctgctgccgccagctctgcctttgccgaggaacttacttttttactacgccaatcccctaactttatcagtgcttttggatccacggctagttcttcagaagcaaccgctttggcaagatcttctgcaattgcagccgctagagccgtgggcgtcgctggtgctgcctctgctatcgcatcagcggcagcgtctgccgctgctggcgtttctcacggatcaagtgctgccgcctatgccagggctatcgcctttgcagttgcgcaagctttcgcaccttttggtatactgactttagctaaggcagcagcctttgctagtcaattcgctagaagcttcagctctagtgctgctgcctccgctgcaagtgcagcatctgctagtgcggcttctgctaagtcggcagcagctgctgcagcatcgagttctaccactagtactagtactacgaccaccagtacaggtacgtcttc

SEQ ID NO: 645 - DNA, 563 bp, Artificial Sequence
  Description of Artificial Sequence: Synthetic polynucleotide
gaagacttagcaggtgctgcgtctgccgccggtgcaagcagtgcagcagcagcatccgcctcggcggcagcagcgagcttcacacaaaatttgatttacagcttgcaagaatccgaaattttttattctgcattaaggagtattgcctcttccggtgaagccagtaacctggcatacttggcagctgagcgagctgcttatggagctggactagacggtattgcaagctcagttgcttcagctgctgcgagcgctttcgctaataccgctttaggttctggagcagccgcctatgcgaaggccctagcatatgctatagcccctgttttaactcgagccaatattattaccctttctaatgctgcctctttggctaccacatatgcaaagggattcgcatctagtgcagccagtgccgcggcctcagccagcgctgcttccgccgctgctgcaagctccgctgcctccgcttcctcagccgcagccgctgcggcggcttcttccagcactagtacaagtactacagtctctcgatctacagccgcagctgcaggtacgtcttc

SEQ ID NO: 646 - DNA, 572 bp, Artificial Sequence
  Description of Artificial Sequence: Synthetic polynucleotide
gaagacttagcaggtgctgcctccgcagcaggtgcagctggagcatcctcagctgctgctgcttccgcctctgctgcagctgcttcattcacaagaaacctgatatactctctccaagagtcagagattttctacagtgctttacgaagcattgctagctctggagaagcatcaaatcttgcttacttggctgcagaacgcgcagcatacggtgcaggtttggatggtatcgcaagttcagttgcctccgctgctgccagcgccttcgctaacactgcactgggttcaggtgctgctgcctatgcaaaagctctggcttatgctatcgctcctgtgcttactagagctaacattataacactgagtaatgccgcctccttagctacaacatacgccagaggctttgcctcgagtgccgcctctgccgctgcgagcgcttctgcagcatctgccgcagccgcttcatccgcagcgtccgcatctagtgctgccgccgctgcagcagccagctcctcaacaagcacttccacaacagtgtccagaagcactgcggcagctgcaggtacgtcttc

SEQ ID NO: 647 - DNA, 572 bp, Artificial Sequence
  Description of Artificial Sequence: Synthetic polynucleotide
gaagacttagcaggtgctgcaagcgctgcaggagctgctggagcttcctccgcagctgctgcttcagcctctgctgctgctgcatcttttacaagaaacttaatttactcccttcaagaatctgagattttttactcagctttgagatcaatcgctagtagcggtgaagcatcaaatctagcctatttggcagctgaacgagctgcatatggagctggactggatggtattgcttcctccgttgcttctgccgccgcttctgcttttgcaaacacagctttgggtagcggagctgctgcctacgctaaagcactagcctatgcaatcgccccagttttgactagagcgaatattatcactttgtcaaacgctgcaagcctcgctacaacttacgctagaggattcgcttcaagcgctgcctccgctgcggcttctgccagcgcagcttcagcagctgcagcctccagcgctgcttctgcttcttccgctgccgctgctgcagctgcttcttcatccactagcacctccacaacagtttctaggtccactgctgcagccgcaggtacgtcttc

SEQ ID NO: 648 - DNA, 566 bp, Artificial Sequence
  Description of Artificial Sequence: Synthetic polynucleotide
gaagacttagcaggtgctgctagcgctgctggcgcagccggagcttccagcgccgctgctgctagtgcctcggcagccgctgcctctttctctaggaacctgatatattcgctgcaagaatctgaaattttttatagcgccttgagatctatcgcctccagcggagaggcatcaaatttggcctatctagctgctgagagagctgcttatggcgcaggtctagatggaatagcttcatctgtcgctagtgctgctgcctctgctttcgcaaataccgcacttggtagtggtgctgccgcctacgcaaaagctcttgcatacgctattgctcctgttttaaccagagcgaatattattactttgtcaaatgcagcaagtttagcaacaacctatgccagaggtttcgcttcttcggcagcttctgccgctgcgtctgcgtccgccgcttctgcggcagcggcttcatctgcagctagcgcaagttccgcagctgcagctgcctcatcttcaacttctactagcacaactgtctccaggtccactgcagcagctgcaggtacgtcttc

SEQ ID NO: 649 - DNA, 548 bp, Artificial Sequence
  Description of Artificial Sequence: Synthetic polynucleotide
gaagacttagcaggtgcagcatcagctgctggagccgctggcgcctcatctgccgcagcggcgagtgcgtccgccgctgctgcttcatttacccgtaacttgatctactcacttcaggagtccgagattttctattcagcccttagatctatcgcgtcctcaggagaagcctctaatttggcatatttagctgcagagcgtgccgcttacggagctggtttggacggaatcgcttcttcggtcgctagcgcagctgcatctgcatttgcaaatacagctttgggatcaggtgccgctgcttatgccaaagccttggcatatgcaattgcacctgttcttaccagagctaacataattacgctgtcaaacgctgcaagcctagctactacatacgctaggggttttgcttcttctgctgcctccgctgccgctagtgccagcgcagcctctgcggcagccgccagttctgcagctagtgctagttcctcatctgctgctgctgcagcagcttcatcatctactagtactaaagctacaggtacgtcttc

SEQ ID NO: 650 - DNA, 530 bp, Artificial Sequence
  Description of Artificial Sequence: Synthetic polynucleotide
gaagacttagcaggtgctggagccggcgctggagctggcgccggagcaggctattcggccggcgctggttacggtattggagctggagccggagtgggcgctggtgctggtgcaggcgcaggtgccggatctggtaccggtactggagccggatatggttacggatcttcaacccaatctagctccaccatttacgctgctacctaccagggtggttatggacgagttgcaggcctgggtgccggagctggtgcaggtgcaggtgcaggaggaggtgcaggtgccggagcaggtacaggtgccggagctggagcaggaataggtgctggttatggtgctggcgcgggttatggagccggagctggaaccggctccggagcaggtgccggtgcaggaggaggcgcagcagctggtgctggttcgggtgttggtgcaggctacggtgcaggagctggctatggagccggagccggagccggtggtggagcaggtgcaggagccggaagcggtgcttcagcaggtacgtcttc

SEQ ID NO: 651 - DNA, 545 bp, Artificial Sequence
  Description of Artificial Sequence: Synthetic polynucleotide
gaagacttagcaggtgctggatacggtgcaggtgctggtgcaggaggtggagccggagctggtactggatatggtggaggtgctggatacggcacaggctctggtgcaggctacggtgcaggagtaggatacggagcaggcgccggagcaggtggtggagcaggagccggagccggcggtggtactggtgccggagccggtggtggagcaggtgcaggctatggagcaggaactggctatggtgccggagctggcgccggtggaggcgcaggagccggagctggcgctggtgcaggagccggtgctggtgccggttcaggtgcgggtgcaggatacggagccggcgctggttacggtgctggcgctggagctggtggagttgccggcgctggagctgccggaggcgctggagcagcaggtggtgcaggagctgccggtggagcaggtgccgccggaggcgccggtgccggtgccggagctggttctggagctggtgctggtgctggtggtggtgctcgtgctggagccggaggaggtacgtcttc

SEQ ID NO: 652 - DNA, 563 bp, Artificial Sequence
  Description of Artificial Sequence: Synthetic polynucleotide
gaagacttagcaggtgctggagccggtgccggatatggagccggagctggttacggagttggtgccggaggcggcgctggcgccggtgcaggagctggtggcggagctggtgcaggcgctggtggaggtgctggagctggagccggatccggcgccggagcaggagcaggaagtggagctggtgctggagcaggtggaggcgccggtgccggtgcaggttcgggtgcaggagccggcgctggttatggcgcggacgcaggtgtaggtggtggtgctggtgctggaaccggttatggtggaggtgccggttatggttctggagctggcgcaggctcaggtgcgggagccggtgctggatatggagcaggagccggttccggaaccggagtgggattcgttgctggtacttctaatagagttgcatcaactacttatagtactatgtacgcaaccggttataatggtggagtcggtgccggagcaggtggaggagccctctctcgtctcttggccgctggttatggagctggtggtggaactgcaacaggtgcaggtacgtcttc

SEQ ID NO: 653 - DNA, 545 bp, Artificial Sequence
  Description of Artificial Sequence: Synthetic polynucleotide
gaagacttagcaggtgctggatatggcgccggagctggcgctggtgctggttccggagcgggattaggtgcgggcgcaggtgctggtttcggtgctggagctggcgccggtgtatcagcaggagcaggtgcaggtattggagcaggagctggtgctggtgtcggagccggagctggtgccggcttcggagccggagcgggcgcgggtgttggagctggtttcggcgccggtgccggtgctggtgtaggagccggtgccggtgcaggcgttggagctggagccggtgctggttctggtgcaggagtcggtgctggtgttggagcgggatttggtgctggcgtaggcgcaggagttggtgcaggcgcaggagcaggcgcaggcgtcggagctggagctggagtgggagccggtgcaggagccggtgtaggtgctggtgctggcgcaggagttggagctggtgccggagctggtgttggtgctggagcaggtgctggctttggcgcaggagtgggagcaggcgtcggagccggagcaggtacgtcttc

SEQ ID NO: 654 - DNA, 497 bp, Artificial Sequence
  Description of Artificial Sequence: Synthetic polynucleotide
gaagacttagcaggtattggtgctggcgccggtgcaggatccggagttggtgcaggagctggcgcaggtagtggaaccggaaccggtgcaggttacggttacggctcttcagcacagtctctctccactcgttattctggagcttatcaaggtagttacggaggtgccggtgctggagctggtgcaggtgcaggagccggtgctggtgctggttctggcgcaggagctggctccggaactggatatggtgccggatcaggtgctggtgccggtgctggtagcggttctggagccggtgctggcaccggcgctggatatggtgctggttcaggcgctggagttggcgttggagccggtgccggttctggttacggcgccggaggaggtgctggagccggagcaggagctggtggaggagctggagctggtaccggtggcggtactggagcaggtgctggtgctgtatacggtgcaggtgccggtgcaggtacgtcttc

SEQ ID NO: 655 - DNA, 500 bp, Artificial Sequence
  Description of Artificial Sequence: Synthetic polynucleotide
gaagacttagcaggtgctggactaggtgctggtactggcgccggtgccggagctggtgcttctgctggaacaggaacgggatatggtcttggcagatacgcccaaggtaccagtgtcacatactcctccacctacggtaatggttactacggaggtttgggagctggatctggaacaggtgctggaggtggtgccggtgcaggagctggatccgccgctggtgccggtgctggtgccggctcaggcgcaggtttaggtgctggtgctggagcaggtgcaggtgcgggctttggtgcaggtgctggtgcgggtgtcggagcaggagctggtgctggaatcggtgctggagcaggagcaggtgttggcgccggagctggagccggctttggcgctggagtaggtggtggtgctggtgctggttccggagctggtgttggtgccggagtgggagctggtgtaggagccggtgcagtggtaggagctggagcaggtacgtcttc

SEQ ID NO: 656 - DNA, 563 bp, Artificial Sequence
  Description of Artificial Sequence: Synthetic polynucleotide
gaagacttagcaggtgcctattctgcagctgctgccgctgcagctactgctacatccggcggagcccctggaggttatggcggttatggcccaggtattggtggtgcctatggtccggcttcttccaccggaacaggtagtggcagtggctcaggcgccggcgctgctggaggaggaggatctggcggtcttggttcaagtggtggaaatggtggtttgggaagcggaaacggaggttctggtgcatcagcagctgcatcggcttctgccgcgagctcatcccctggaagtggaggctacggtccaggacagggagccggattcggctctggctcggcagctgctggtggatctggcacaggctcaggtgccggtggtcctggatcaggaggctatggtggacctcaattttttgcatccaacacgttcgcctcagcctacggaggtcaaggtctattaggaacatctggatatggcactggtcaaggtggagcttctggaactggctcctctggtggcggcggttcaggttcaggaacgggatctaactcaggtacgtcttc

SEQ ID NO: 657 - DNA, 548 bp, Artificial Sequence
  Description of Artificial Sequence: Synthetic polynucleotide
gaagacttagcaggtgcttcttcggctgctgcagctgctgctgctaccgctacatcgggaggagctccaggtggatatggaggatacggtccaggcatcggtggtgcatttgttcctgcttccactacaggtactggctccggctccggttccggtgctggagctgcaggttcaggaggacttggtggacttggttcatccggaggaagtggaggactaggtggtggaaacggaggatccggagcctcagctgccgcttctgcggcagctgcttcttcatcacctggtagtggaggttatggacctggacagggagtaggatctggaagtggcagcggtgcagcaggaggatcaggaaccggttctggtgcaggaggtccaggatcaggtggatacggtggtccacaattttttgcatcggcctacggtggtcaaggcttacttggtacatctggatacggtaacggtcaaggaggtgcctcaggaacgggtagcggaggagtgggaggttcgggatcaggagctggttctaattcaggtacgtcttc

SEQ ID NO: 658 - DNA, 722 bp, Artificial Sequence
  Description of Artificial Sequence: Synthetic polynucleotide
gaagacttagcaggtggtgccggtagcggacaaggaggttacggtggacagggtggcttgggaggttatggccaaggcgctggagccggtgcagccgccgctactgctgctggaggtgctggatctggtcaaggagactacggtgaccagggaggcctgggaggatatggtcaaggatctggtgccggttcagctactgctcctgcagctggaggttcaggttttggacaaggtggattcggtaatagaggtggaaaaggtgcctatggacaatccgctggtgctggtgtcggcgctgcggccacagccgccgctggaggagcaggatcaggccaaggcggttatggtgaccaaggaggtttgggaggttacggacagggtgcaggagccggtgccgcatcggctgccgccggtggtggtgatggctacgaacaaggtggttacggtaaccaaggaggacttggcagttttggacaaggcgccggtgctggagctgccgctgcggcctccgccggaggtgccggatctggtcgaggtggatatggagatcagggtggtttgggtggttacggccaaggagctggtgctggagctgcttccgccgctgccggaggaggcgacggttatggtcagggctattatggcgatcaaggtggtagaggaggttatggtcagggttctggtgctggcagtgctacggcagctgctgcaggtacgtcttc

SEQ ID NO: 659 - DNA, 857 bp, Artificial Sequence
  Description of Artificial Sequence: Synthetic polynucleotide
gaagacttagcaggtggtgcaggtttcggtcaaggcggatacggtcagggtggctatggcaaccaaggaggtttgggatcctttggacaaggtgctggtgctggcgccgctgccgccgcatcagcaggtggtgctggtagtggaagaggtggatacggcgaccaaggaggtttaggtggttacggccaaggtgcaggagcaggagcagcagctgctgcagcaggaggtggagatggatacggtcagggaggttatggaaaccaaggaggcctaggctcattcggtcagggagccggagccggtgccgcagctgccgcctctgctggaggtgccggctcaggacgtggtggttatggacaaggaggttatggcaaccagggtggtttaggttcattcggacaaggagctggcgctggtgccgccgccgctgcatccgcaggtggtgcaggttctggacgtggcggttacggcgaccagggtggattaggaggttacggtcagggcgctggatctggtgccgctgctgctgcagccggaggaggtgacggttacggacaaggcggatatggtaaccagggtggactcggttcctttggtcaaggtgctggagctggtgctgctgccgcggcatcagctggtggtgccggatcgggtcgtggtggatatggccaaggtggatacggaaaccagggtggactaggatcttttggacagggagcaggagcaggtgcggctgccgctgcatcagctggaggagccggatcgggtaggggaggatatggagatcaaggtggtctgggtggctacggtcagggtgccggagctggtgctgcctctgcagctgcaggtacgtcttc

SEQ ID NO: 660 - DNA, 530 bp, Artificial Sequence
  Description of Artificial Sequence: Synthetic polynucleotide
gaagacttagcaggtggtggagatggctacggccaaggtggatacggtaatcaaagaggagttggatcctatggtcagggcgctggcgctggtgcagctgccacatctgccgcgggaggcgctggtagcggaagaggtggttacggtgagcaaggaggccttggaggttacggccagggagctggtgctggagcagctagtaccgctgcgggaggtggtgatggatatggtcaaggaggatacggtaaccaaggtggacgtggttcttacggacaaggatctggagcaggtgcgggagccgcagtagctgcagcggccggcggtgctgtttcaggccaaggaggttatgatggtgaaggtggtcaaggtggttatggtcagggatctggtgctggagctgcagttgctgccgcctctggtggaaccggcgctggtcaaggaggttacggctctcaaggttctcaagcaggttacggtcagggtgctggttttagagcagctgctgctaccgcggctgcaggtacgtcttc

SEQ ID NO: 661 - DNA, 512 bp, Artificial Sequence
  Description of Artificial Sequence: Synthetic polynucleotide
gaagacttagcaggtgcatatgcttatgcatatgctattgctaacgcatctcagattgcagcttccgttgcctcagctgttgcctcaagcgcatcagctgcggctgccgctgcatcgagcagtgctgcagccgctgctggtgcatcctcggcggctggagctgcatcctcttcgtccactaccacaacaactagtacttctagctctgccgctgctgcagctgcggcagcggcagccgcttcagcaagtggagcttcaagtgcgtctgctgctgcatctgcttctgctgccgcttctgctttttcctcagccctaattagcgatctacttggtatcggagtctttggaaacacctttggctctattggttccgcttcagcagcttcatcgatagccagtgctgccgcacaagctgccttaagtggattaggtttgtcctacctagcttctgcaggtgcatcagcagtggcctcggccgttgccggagtgggtgttggagcaggtacgtcttc

SEQ ID NO: 662 - DNA, 515 bp, Artificial Sequence
  Description of Artificial Sequence: Synthetic polynucleotide
gaagacttagcaggtgcttacgcgtatgcttatgctatcgccaacgctttcgccagtattttggcaaatacaggattactgtcagtttcgtcagcagcctctgttgcttcttctgtggcttcggccatagccacctctgttagttcatcttctgctgctgcagccgcttcagcttccgctgcagctgcggcaagtgcttcggcagcaagttcagcttcagcctcatcgtccgcaagtgctgcggccgccgcaggtgcctctgccgccgctggtgcggcatcatcggcgtctgcaagcgccgccgcctccgcatttagcagcgcgttcatatctgctcttctaggtttctcacaatttaactcggtgttcggttctattacatccgctagcttgggattgggaatcgctgctaacgcagttcagtcaggactagcgtcactaggtctaggtgctgctgcatcagccgctgcctctgcagttgccaacgcgggcttaaatggctcaggtacgtcttc

SEQ ID NO: 663 - DNA, 557 bp, Artificial Sequence
  Description of Artificial Sequence: Synthetic polynucleotide
gaagacttagcaggtgcttatgcttacgcgacggcaattgcttcagcgattggtaacgcactattaggtgcgggattcttgacagctggaaacgctagccagatagctgcttctgtagcaagtgctgtggcatcatcggcatcagccgccgctgcagcagccagttctagcgcggccgcagctggtgctagctctgctgctggagcagcttcatcctccagtacaaccactaccacatctacttcatcgtcggcagctgctgctgcagctgccgctgctgccgcatccgcttcaggtgcctcttctgcgagcgcagcggcttctgctagtgccgctgctagcgctttcagtagcgctttgatcggtgacttgttgggtataggtgtattcggaaataccttcggatctatcggtagcgcatccgctgcttcaagtattgcttctgctgctgctcaagctgcattgagcggacttggactgagttatcttgcttcagccggtgcctcagccgttgccagcgcagtcgccggagttggcgtgggagcaggtacgtcttc

SEQ ID NO: 664 - DNA, 779 bp, Artificial Sequence
  Description of Artificial Sequence: Synthetic polynucleotide
gaagacttagcaggtgcgggcgctggagctggtgccggcgccggagccggagcaggcgctggttccggcgcttctactagcgtctcaactagcagtagttcaggtagcggtgcgggtgcaggagctggttctggtgctggttctggagcaggtgccggatctggtgctggagccggtgcaggtgcaggtggtgcaggcgctggtttcggatctggtctgggtctaggatacggcgtgggcttatcttctgcacaagcgcaagctcaggcccaagcagctgctcaagctcaagctcaagcacaagcacaggcttatgccgctgcacaggctcaagcacaggcccaagcccaagcgcaggctgcagcagctgcagctgctgccgctgctgctggtgcaggtgctggtgctggcgctggtgctggtgcaggtgccggtgccggttccggagcttcgaccagtgtaagcacatcttccagctccggctccggtgctggtgccggagcaggatcaggtgctggttcgggtgctggtgcgggatcaggtgctggagcaggagctggtgccggtggtgctggagctggattcggtagcggacttggacttggatatggtgttggcttaagctcagcacaagcacaagctcaagcccaagctgctgcacaggctcaggctcaagctcaggctcaagcctacgctgctgctcaagcccaagcacaagcccaagcccaggcccaagctgcagctgccgctgctgccgcggccgccgcaggtacgtcttc

SEQ ID NO: 665 - DNA, 779 bp, Artificial Sequence
  Description of Artificial Sequence: Synthetic polynucleotide
gaagacttagcaggtgcaggtgcaggtgctggtgccggagcaggagcgggagctggagcaggttccggtgccagtacctctgtctcgacctcatcatcttctggaagtggtgctggagctggtgcgggatccggtgctggatctggtgcgggtgcaggaagcggtgctggtgctggcgccggtgcaggtggtgcaggagcagcttttggaagtggtttaggattgggttatggagttggattgtcctccgcacaggctcaggcgcaagcacaagcagctgcccaagctcaagctgatgctcaggcacaagcctacgcagccgcccaggctcaggctcaagctcaggcccaggctcaagctgctgcagctgccgccgcagctgctgctgctggcgctggagcaggtgcaggcgctggttccggagctggagcaggagctggatcgggcgcatctacctccgtctctacctcatcttcttcaggttctggagctggcgcaggagccggttctggagccggttcgggtgctggcgctggatccggagctggtgcaggagcaggtgctggaggagcgggtgccggtttcggaagtggacttggtcttggttacggagttggtctgagttctgctcaggcgcaagcccaagctcaagcagctgcacaagcgcaggctgacgcacaagctcaagcctatgccgctgctcaagcacaagcccaggcccaggcacaagctcaggcagccgcggccgccgctgctgcggcagccgcaggtacgtcttc

SEQ ID NO: 666 - DNA, 779 bp, Artificial Sequence
  Description of Artificial Sequence: Synthetic polynucleotide
gaagacttagcaggtgctggagccggcgctggtgctggatctggagctggtgcaggagccggttcaggtgcctcaacaagtgtctctacaagttcttctagtggttcaggtgctggtgctggtgcaggatctggagccggatctggtgctggcgcgggtagtggagctggcgcaggagctggtgcgggtggcgccggagctggcttcggctccggtttgggacttggttacggcgtaggtctttcttctgcacaagctcaagcgcaatctgctgcagcagctagagctcaggccgacgctcaggcacaagcatacgctgctgcacaagcacaggcccaggcccaggcacaggcacaagccgccgcagctgctgccgctgctgctgctgcaggagctggagcgggcgctggtgccggagcaggagctggtgctggagcaggttcaggagcatcaactagcgtttccaccagttcctcatcagcttctggtgctggtgctggcgccggtagcggagcgggttctggagccggtgccggttccggagcaggtgcaggagccggagctggcggcgccggcgcaggttttggaagtggtttgggtcttggctacggtgtaggattaagctcagcccaggctcaagctcaagcacaagccgctgcccaggctcaggctcaagctcaggcacaagctctcgccgctgctcaagctcaagctcaggcgcaagctcaagcccaagctgccgctgccactgcagcggctgctgctgcaggtacgtcttc

SEQ ID NO: 667 - DNA, 605 bp, Artificial Sequence
  Description of Artificial Sequence: Synthetic polynucleotide
gaagacttagcaggtcaaggaacggactctgtcgcaagcagcgcttcttcctctgctagtgcctcttcttcagccacgggaccagataccggatatcctgtaggttactatggtgctggacaagccgaagctgctgcttctgctgccgccgcagcagctgcttccgctgctgaggctgctacgattgccggtttgggttacggtagacagggacagggaactgattcatcagcctcttctgtttctaccagtaccagtgtcagttctttggcaacaggacctggttcgcgatatccagtgagggactatggagcagatcaagcagaggccgccgcatcagccgcagccgccgcttctgccgctgaggaaattgcttctttaggttatggtcgtcagggacaaggtacagatagtgtcgcttccagtgctagttcatctgcaagcgccagtagctcagccactggaccggatacaggttaccccgtaggttattacggagccggacaggccgaggctgctgcatcagctgcggctgccgctgccgccagtgccgctgaagccgctactatcgcaggtttgggatatggtagacaaggtacgtcttc

SEQ ID NO: 668 - DNA, 617 bp, Artificial Sequence
  Description of Artificial Sequence: Synthetic polynucleotide
gaagacttagcaggtcagggaacagattcttcggcttcatcggtatccacctctacctctgtatcttcctctgctactggacctgatacaggttatcctgtcggatattacggcgctggacaggcagaagcagctgccagcgctgcagcggcagccgctgctagcgcagccgaagccgccacaattgccggacttggttacggcagacaaggtcagggaaccgacagctcggcctcttctgtatcaactagtacttcagtgagtagttcagctactggtccagatatgggttatccagtgggaaactatggagcaggacaagctgaagccgccgcttcagctgctgctgcagccgctgcatccgcagcagaggctgcgactattgcatctcttggatatggccgtcaaggacagggtactgattcatccgctagctcagtctctacaagtacctctgtctccagttctgcaactggtccaggttcacgttatcctgttagggattatggagctgaccaggccgaggctgctgctagtgccgcagcagcagcagctgctgcagcctctgctgcagaggaaatcgccagtctgggatacggtaggcaaggtacgtcttc

SEQ ID NO: 669 - DNA, 617 bp, Artificial Sequence
  Description of Artificial Sequence: Synthetic polynucleotide
gaagacttagcaggtcagggcacagactccgttgcgagctcggcttcttcatctgcatctgcaagctcttcagcaacaggtcctgataccggttacccagttggatattatggagcgggtcaagcagaagctgcagctagtgccgcagcagccgccgctgcatccgctgctgaggcagccactattgcaggtttgggttacggacgacaaggacaaggtacagattctagtgcatctagtgttagtacctccacatctgttagctcttcagctacaggaccaggatccaggtatccagtcagagattatggagcagaccaagcagaggccgcagcctctgctaccgccgcagctgcagctgccgctagtgctgctgaagaaattgctagtcttggttatggacgccaaggacagggaacagacagtgttgcatcctctgcctcctcgtccgcttctgcatcatcgtcagccaccggtcctgatactggttatcctgtcggttactacggagctggtcaagccgaggctgcagcttcagccgcagcggcagctgctgcttcagccgctgaggccgccaccattgctggtctaggatatggtcgacaaggtacgtcttc

SEQ ID NO: 670 - DNA, 644 bp, Artificial Sequence
  Description of Artificial Sequence: Synthetic polynucleotide
gaagacttagcaggtgtctccctatctagttctcaggctacatcggtggctagcgcaattagcagttccttgtatgcttttaactaccaagctagtgccgcttcatcagctgcggctcaatccagtgcccaaacagcaagtaccagtgctaagcagacggctgcgtcaacttctgcatccacagcggccaccagcacaacgcaaacagctgcaacaacctcagcctcaacagccgcatcgagtcaaacagtacagaaggcttctacatcaagtgccgcatccaccgcagcaagcaagagccaaagttcttctgccggctcttcaaggactacatctacagccgcagcctctgcaagcagctcttacgctttcgctcagtcgttatctcaatacttactgtcgtcgcagcagttcaccaccgcttttgcctcttccactgcagtggcatcctcccagcaatatgctgaggccatggctcaaagcgtggcaacgtcgttgggcttgggatacacttatgccagcgcactctcggttgccatggcccaagctatttctggagtcggtggtggtgcttctgcttactcatatgctacagccatttcacaggcaatatccagggctttgacatcttcaggtacgtcttc

SEQ ID NO: 671 - DNA, 641 bp, Artificial Sequence
  Description of Artificial Sequence: Synthetic polynucleotide
gaagacttagcaggtgtctctctttcttcttcgcaagctacttctgtagcttctgcaatcagcagctcattatacgcatttaattatcaagcttctgccgctagttccgctgcagcccagagctctgcccagaccgcaagcacatcagctaagcagaccgcggctagtacgtcagcatccacggctgctacatctaccacccaaacggctgcgaccactagcgcttctactgctgcctctagtcagacagtccaaaaagcctccacgagttctgcagcaagtacagcagcgtcaaagagccaatcttcttctgtgggtagttccacaacctcgactgcagcagcttccgccagttcttcatacgcttttgctcagtctttgtcccaatatttgttgagttctcaacaatttacaacggcttttgcaagttccaccgctgttgctagttcacaacaatatgctgaagccatggcccagagtgttgctactagcttaggacttggatacacctacacttcggccctgagcgtcgctatggctcaagcaattagcggtgtcggcggaggagcctctgcttactcctacgccactgccatttcacaggcaatttcaagagttttaacttcttcaggtacgtcttc

SEQ ID NO: 672 - DNA, 641 bp, Artificial Sequence
  Description of Artificial Sequence: Synthetic polynucleotide
gaagacttagcaggtatatccctgtcgtcaagtcaagctacttccgtggccagtgctataagttcttctctatacgcttttaactatcaggcttctgccgcttcatcggctgccgcacagtcatctgcgcaaacggcaagtacgtccgctaaacaaactgctgcttctacctctgcctctacagctgctacttcaacgacacaaacagctgccacaacctcggctagtacggctgctagttcgcagacagttcaaaaagcgtcaacttcttccgccgcctctaccgcagcatctaaatcacaatcttcctccgtgggttcaagcactacatctacagccgctgcgtcggcgtcctcttcgtatgcttttgcccaaagtttgtctcagtatctcttgtccagccaacaatttacaacagcttttgcaagctcaactgccgttgcttcatctcaacagtatgccgaagctatggctcagagtgtcgccacttcgttaggcttgggttacacttatacatccgctttgtccgtggcaatggcacaggccatatctggagttggtggtggagctagtgcttacagttatgctaccgccatttctcaggctatatcaagagtgctaacttcgtcaggtacgtcttc

SEQ ID NO: 673 - DNA, 566 bp, Artificial Sequence
  Description of Artificial Sequence: Synthetic polynucleotide
gaagacttagcaggtagcagtgcatacgactctcaattcagtgagagctcatctgcctcgtctgctgcagccagtgccttctcggaacagacctcctacgacatatcctcggatctttcttccgcatcaagtgctactgccgcagccgcgtcgtcgtctgcatatgaatcacaattctctgatgcttcttccggttcatcggcagcagctgcggcaagtagtcaacagaattcatacgatactgacgccttgtattctgcttcatctgctgcctccgcagctgcttctgcaagtgcatacgaactagagttttcagatgcatcttcatcgtctagtgctgtcgcagttgcatcttcacaacagggctcatacgatacctcctcagacttttctagtgctagttccgctgctgccgccgcagcttctgcttatgagtctaagttcttggatgcttcttcatctagctcggctgccgctgcagcaagttctcaacaatcatcatatgagacgagttcagacctcgtatctgctagttcagctgccgctgctgcggcaggtacgtcttc

SEQ ID NO: 674 - DNA, 554 bp, Artificial Sequence
  Description of Artificial Sequence: Synthetic polynucleotide
gaagacttagcaggtgcatcagcatatcagtcgcagttcttggatgcttcatcttcgtccaacgcagctgctaccacttcctcaagacaatccagttatgataccagttcagacttttcctcggcttcaatcgcagccgccgcagcggctagtgcctcatcatacgagagtcaattttcagatgcatccagttcctctaatgccgcagcggcagcctcgtcccaacaatcgtcttatgatacatcatctgatctggtttctgcagcttcggcgtctgcctacgaatcccagttcctagatgcttcctcaagtagtaatgccgccgctactacaagtagtcagcagtcctcctatgatacttcatcagatttctcttccgcttctattgctgctgctgccgctgcgagtgcttcatcgtacgagtcccaattctctgatgccagctcttcttccaacgccgccgctgcggcaagttcccaacagtctagctatgatacatccagcgatttggtgagcgctagttcagctgctgctgcagctgcaggtacgtcttc

SEQ ID NO: 675 - DNA, 707 bp, Artificial Sequence
  Description of Artificial Sequence: Synthetic polynucleotide
gaagacttagcaggtgcttcatcttacgagtcacaattttccgacgcatcttctagtagtaacgccgccgcggcagcttcgtctcaacagtcatcatacgatacctcttctgacttagtctctgcttcttctgccgcagctgccgccgctagtgcttcagcttatgaaagccagttcagcgacgcttcttcatctcgaaatgctgccgcagctgcatcgtctcaacaaagctcctacgatacttcatccgacttggtatctgcatcatccgccgctgcagccgctgcctcagcaagctcttacgaatctcaatttttagatgcctcttcctcgtctaacgctgccgctaccacttcatctcagcaatcctcatatgacacgtcatcagattttagtagtgcttccattgcggctgctgtagccgcctctgccagctcttatgaatctcaattttccgatgcctcttcatcgagtaaagccgcagctgcagcaagttcccaacagagttcttacgatactagcagtgatttagtttccgccagtagtgcagctgcagcagccgcgagtgcttctagttacgaatcacagttttctgatgcgagttcgagttccaacgcagccgccgccgcatccagtcaacagtcatcctacgatacctcaagtgacttttccagtgctaattccgccgcactggcaggtacgtcttc

SEQ ID NO: 676 - DNA, 740 bp, Artificial Sequence
  Description of Artificial Sequence: Synthetic polynucleotide
gaagacttagcaggtgctgcgcagaaacagccatcaggagagtctagtgttgccactgcaagcgcggctgcaacctcagtgacctcaggtggagcaccagttggaaagccaggtgtcccagcaccaatattttaccctcaaggtccgttacagcagggacctgcacctggaccttccaacgtccagcctggtacctctcagcaaggtccgatcggtggcgttggtggctcaaatgcgttttcgtcgtcattcgccagtgccttatccctaaaccgaggttttacagaagttatcagctctgcttccgcaacggctgttgcaagtgcttttcagaagggtctagctccatatggaactgccttcgctctgtcagcagcttccgcggctgctgatgcgtacaacagcattggatccggagctaatgcattcgcatatgctcaagcttttgctagagttctgtatccattggtcagacaatatggactatctagctctggtaaagcatctgcgttcgcctcagctattgcttcttctttctcttccggtacttctggacaaggaccgtccattggacagcaacaaccaccagtaactatttctgccgcctcggcctcagctggagcttcagctgcagccgtaggaggtggtcaagttggtcagggaccgtatggtggacaacaacaatccactgctgcctcagccagtgctgcagcagctactgccacatcaggtacgtcttc

SEQ ID NO: 677 - DNA, 740 bp, Artificial Sequence
  Description of Artificial Sequence: Synthetic polynucleotide
gaagacttagcaggtgctgcccagaaacaacctagtggtgagagttccgtagctactgcatctgcagcggccacttcagtgacttcgggtggtgctcctgtaggaaaacctggtgtacctgccccaatattttacccacaaggtccgttgcaacagggcccagcaccgggtccatcgaacgtccaacctggaacatcccagcaaggtccaattggtggtgtgggaggctctaacgcgttctcctcttcctttgcaagcgctctgtctttaaaccgaggtttcactgaagtgatatctagtgcttctgcaacagcggtggcttcagcgttccaaaaaggattagccccttatggcaccgcctttgcattgagcgcggcctctgccgctgccgatgcctataatagtatcggcagtggagctaatgctttcgcctatgcgcaagcattcgctagagtcctttacccacttgtgaggcagtatggtttaagttcgtctggaaaagctagtgcttttgcgtcagcaattgccagttcattctcttcaggtacttcgggtcaaggaccttctattggacagcaacaacctcctgtcacaatttctgctgcctctgccagtgctggcgcttctgcagcagctgtgggcggcggtcaggttggtcagggcccatacggtggacaacagcagagtactgcagcctctgcttcagcagcggccgccacagcaacttcaggtacgtcttc

SEQ ID NO: 678 - DNA, 740 bp, Artificial Sequence
  Description of Artificial Sequence: Synthetic polynucleotide
gaagacttagcaggtgctgctcagaagcaaccatcgggagaaagttccgtagcgactgccagtgcggctgcaacatctgtgacttccggtggtgctcctgtaggtaagccaggagtgcctgcacctatcttctatccacaaggtccactacaacagggtcctgctccgggaccatctaatgtgcaaccaggtacgtcccaacagggacctattggtggtgtgggaggaagcaacgctttttcttcctcatttgcatcggctctttccctaaaccgcggatttactgaggtcatttcttccgcttctgctactgcagtggcctctgcttttcagaaaggtcttgccccatatggcactgctttcgcgctctcagcggcttcggctgcagctgatgcttataattccattggtagtggagctaacgcttttgcatacgctcaggcatttgccagggtattatacccattggttcagcaatatggtctttcttcaagtgctaaggcttcagcttttgcttctgcaatcgcatctagcttttctagcggtacatctggacagggaccaagtattggacaacaacagccaccggttacgatttctgctgccagcgcttcagcaggtgccagcgcagccgcagtcggaggtggtcaggtcggtcaaggcccgtatggtggtcaacagcaatcaacagctgcatcagcatctgccgcagctgccactgctacctcaggtacgtcttc

SEQ ID NO: 679 - DNA, 740 bp, Artificial Sequence
  Description of Artificial Sequence: Synthetic polynucleotide
gaagacttagcaggtggtgctcaaaagcaaccatcaggtgaaagttctgtagctactgcttcggctgcagctactagcgttacctcagcaggtgctcctgtaggcaagccgggagtacctgcaccaattttttacccacaaggtcctctacaacagggtccagctcctggtccctcgaacgtccagccaggtacaagtcaacaaggtccaattggtggtgtgggtggaagtaatgccttcagtagcagtttcgcctcagccctctcattgaacagaggattcaccgaagtgatcagtagtgcctccgccaccgctgtggcatctgcttttcaaaaaggtctagctccttacggtacagcatttgctttatctgctgcctccgctgcagccgatgcctataatagcatcggatctggagctaacgcttttgcctatgctcaggccttcgccagagtattatacccattagtacaacaatacggactttcttcgagtgctaaggctagtgctttcgcatctgcaattgcatcatcatttagttcaggaacttctggtcagggtccatctaacggtcaacaacagcctccagttaccatatctgcagcatcagcttcagctggtgcctcagcagctgctgtcggaggaggtcaggtttctcaaggaccatatggtggacaacagcaatccacagctgcctctgcaagtgccgctgctgctaccgcaacttcaggtacgtcttc

SEQ ID NO: 680 - DNA, 740 bp, Artificial Sequence
  Description of Artificial Sequence: Synthetic polynucleotide
gaagacttagcaggtggtgcacagaaacaaccttctggtgaaagttccgtcgctactgctagcgctgccgcaacttcggttacgtctgctggagctcctggcggtaagccgggtgtaccggctcctattttctatcctcaaggtccgctgcaacagggaccagcgccaggaccttctaatgtgcaaccgggaacctctcaacaaggaccaatcggaggcgtaggtggaagtaatgctttttcttcttcattcgcctctgctctttctctcaaccgtggttttacagaggtaatatcatccgctagcgctaccgcagtggcaagtgcttttcaaaagggtcttgctccatatggaactgcttttgccttgtctgctgctagtgcggctgctgatgcttacaactccataggctcaggagccaatgcttttgcttacgctcaagcatttgctcgtgtattgtatcctctggtacagcaatacggactttcatcatccgcaaaggcctcagcctttgcctcagctatagcatcttcgttctctagtggtactagcggccaaggaccttcgattggccaacaacagccaccagtcactatttcagcagccagtgcttcagctggagcatctgctgcagcagtcggtggcggtcaagtaggtcagggaccatacggaggtcagcaacaatcaaccgctgcttccgcttctgctgcggcggcaacagcaacctcaggtacgtcttc

SEQ ID NO: 681 - DNA, 749 bp, Artificial Sequence
  Description of Artificial Sequence: Synthetic polynucleotide
gaagacttagcaggtggcgcacagaagcagccttcaggtgagagttccgtcgcaactgcttcagctgctgcaacatcagttacctctgccggtgctccagtgggaaaaccgggtgtacctgcacctattttttacccacagggtccactccaacaaggaccagcacctggaccttcatacgtgcagccagctactagccagcagggtcctattggtggagccggacgttctaacgcgttttcctcatcattcgccagtgctctgtcaggaaatagaggtttttctgaagttatctcttctgcgtccgcaacagccgtcgcatcggcttttcaaaagggtttggctccctatggtaccgcatttgcattaagtgcagcttcggctgccgccgacgcatacaacagtattggaagcggcgccaatgctttcgcatacgcgcaagcttttgccagagtgttgtaccctttggtacaacaatatggtttgtccagcagtgctaaagcatctgctttcgctagtgcaatcgcatcatcattttcttcgggcgccgcaggacagggtcagtcaattccgtatggaggacagcaacaaccacccatgaccatttcagccgcttctgcatctgcaggtgcttccgctgcagcagttaaaggaggtcaggttggacaaggtccatacggaggtcaacaacaatcaacggctgcatcggctagtgccgctgcaacgactgccacagcaggtacgtcttc

SEQ ID NO: 682 - DNA, 758 bp, Artificial Sequence
  Description of Artificial Sequence: Synthetic polynucleotide
gaagacttagcaggtggtgcacaaaaacatccatccggtgaatactccgtggcaacagcaagcgctgctgccacctccgtaacatctggaggtgcacccgtgggcaaaccaggtgtccctgcaccaatcttctatccacaaggacctttgcagcaaggtccagctcctggtccatcgaacgttcaacctggtacgtcacaacaaggtcctatcggaggtgtcggagaatctaacacgttctctagttcatttgctagtgcattgggaggaaacagaggtttttcgggtgtaatttcttccgcatctgccaccgcagtagctagcgcctttcaaaaaggcttggcgccttatggtaccgctttcgccctttctgcagcatcggcggccgctgatgcatataacagcatcggttccggcgcatctgcatcagcttacgctcaggcctttgctcgagtgttgtacccattgttacagcaatatggactatcatctagtgccgacgctagcgctttcgcatctgctatagcctcctcattctcaactggtgtagctggccagggtccgtctgttccttatgtaggacagcagcagccttctataatggttagtgctgcaagtgcttcagctgctgcatctgccgctgcggtaggtggaggtcccgtggttcaaggcccatacgacggcggtcaaccacaacaacctaatattgctgctagtgctgctgctgccgccaccgcaacatcctcaggtacgtcttc

SEQ ID NO: 683 - DNA, 605 bp, Artificial Sequence
  Description of Artificial Sequence: Synthetic polynucleotide
gaagacttagcaggttccttgggttaccagttagcattgcaaacagctaactcattgggaatccaaaatgctgcttcactggcctctgctgtggctcaagccgtgagcgccgtaggtgtcagggcaagctcatatgcctatgcaagcgccatttccaacaccgttggtcaattcttaaccagccaaggattgctttcgcaatcgaacgcatctgccttggcatccagttttgcctccgcctttgctgcatctgccgcttcagcaagcgcctctgccagtagttcttcttacgcccaatcatcggccgccgctcaatcgcagtctgcagcgagtgctttcacccgcgcagcatctgcagctgcaagccaagctagttctcagtctgcatcacaagccggttcgtatggaagaacaactacaacttctacttcgcaaagtggagcacaagcaggatcacaggccgcttcacaagcttcctctagtagctgggctgctgcttcggcctcagcgttcgcccagtcatctgcatcgtcgctcgcctcatcctcagccttctcctctgctttctcatctgcaagttcagcttctgcagtaggtacgtcttc

SEQ ID NO: 684 - DNA, 605 bp, Artificial Sequence
  Description of Artificial Sequence: Synthetic polynucleotide
gaagacttagcaggttcgttgtgttaccaactcgcgctgcagacagccaactctcttggtatacagaatgcagcctcgctagctagtgctgtctcacaggctgtttcagccgtcggcgttagagcttctagttatgcttatgcgagtgctattagtaatactgttggtcagtttttgatcagtcaaggtttattgagccagtctaatgctagtgcgttagcaagctcttttgcctctgcttttgcagctagcgcagcgtcggcctccgcttcagcctcgagttcatcctatgctcaatcctctgctgccgcacaatcccaaagtgcggcctcagccttcagcagagctgctagtgcagccgcgtctcaagctagtagccaatccgcctctcaagctggaagttatggacgcactactaccacttctacctccgaatctggcgcccaagccgcttctcaagctgcgagccaagcttcctcttcttcatgggcggccgcaagtgccagtgcctttgctcaatcttcagcttcctctctagcgtctagtagcgcgttcgcttcagcattttcttctgcaagttcaacgtctgcagtaggtacgtcttc

SEQ ID NO: 685 - DNA, 569 bp, Artificial Sequence
  Description of Artificial Sequence: Synthetic polynucleotide
gaagacttagcaggtaacgtgggctatcaattaggacttaaggtagcaaactcactgggccttggaaatgctcaggccctggcatccagtctctcacaagctgtttccgctgtgggtgtcggtgcatcttcgaatgcttatgctaatgcagtcagtaacgccgttggtcaagtcctggctggtcagggaatcttgaacgcagcaaatgccggaagcttggcttcatcgtttgcctcagctttgtctagttctgctgcttctgtcgcaagccaatctgcttcgcaatctcaagctgcaagtcaatcccaagctgcagctagtgcattcagacaggccgcatcacaatccgcctctcaatcggcaagtagagctggaagtcagtcatctacaaagactacttctacgtccacctcaggttcacaagcagatagccgatcggcatcttcttcagcatcacaagcttcagcctctgccttcgctcagcagtctagcgctagcctgtctagctcctcctcatttagttcggctttctcctcagcaacatcaatatccgcagtaggtacgtcttc

SEQ ID NO: 686 - DNA, 569 bp, Artificial Sequence
  Description of Artificial Sequence: Synthetic polynucleotide
gaagacttagcaggtaatgttggttaccagttgggacttaaagttgctaattcgcttggtttgggaaacgctcaggctttagcttctagtttgagtcaagcagtttccgctgtgggagttggagcttcttcaaatgcttacgctaatgcagttagtaatgctgttggacaagtactggccggccaaggaattttgaacgctgcaaatgccggttctttggcctctagctttgctagcgctctctcttccagcgcagcttccgtcgcaagccaatctgccagccaatctcaggcggctagtcagagtcaggctgccgcttccgcttttagacaggctgcttctcaatctgcatctcaatccgactccagagctggatcacaaagtagcactaaaactacatcgactagtacgtctggctctcaggcagattcaagatcagcttcatcctcagccagccaagcgtcggcctcagccttcgcccaacagagtagcgcgagtctatctagttcttcctcattttcttcagctttcagttctgctacttcgatatccgctgtaggtacgtcttc

SEQ ID NO: 687 - DNA, 569 bp, Artificial Sequence
  Description of Artificial Sequence: Synthetic polynucleotide
gaagacttagcaggtaacgtcggttaccaacttggtcttaaggtggctaactcactaggacttggaaatgctcaagcattggctagctctctgtctcaagccgttagtgctgttggagtgggcgcttccagtaatgcttacgctaacgctgtgtcaaatgcagttggtcaagtcctagcaggtcaaggaattctaaacgccgctaatgccggctctctcgcttcttctttcgctagcgctttgagttcaagtgctgcttccgttgcttcacaatcggcctctcaatcacaagcggcttcgcaatctcaagcggctgcctctgcattcagacaggcggcaagtcaatctgcttcccagtcggcctcccgtgcaggttctcaatcatccacaaagactaccagcacgtccactagtggtagccaagccgattcccgctctgcttcaagtagtgctagtcaggccagcgcgtcagccttcgctcaacaatctagtgcatctctaagttcgtcatcgtctttctctagcgcattcagcagcgctacatctataagtgcagtaggtacgtcttc

SEQ ID NO: 688 - DNA, 551 bp, Artificial Sequence
  Description of Artificial Sequence: Synthetic polynucleotide
gaagacttagcaggttcacaagccgcctctcagtcggcaagctcttctgcatcccaagcttcggcctcttcttttgctcaggcatcatccgcatctttggcagcctcttcctctttttcatcagccttttcctcagcaacttctctcagtgctcttggcaatgttgcttaccagttgggttttaacgtaggaacaaacttaggcttaacgaatgctgctggcttggctgcagccatctcacaggcagcatcctctgtaggtgtgggagcctcatctggtgcctatgctaatgctttgtcaaatgccgccgcccaatttttgagtgctcaaggtattttaaacacggtcaatgctggatcattagctagcagttttgcatcagcattgtcgtcagtagctgcctctgctgcagctcaagcaagttcacaaagccaagctgcaagtagtgcattttctagagctgcgagccagtcagcatcccagtcagccgcaagatcaggtgctcagagtagctcctctactaccacaacctctacatcaggtacgtcttc

SEQ ID NO: 689 - DNA, 551 bp, Artificial Sequence
  Description of Artificial Sequence: Synthetic polynucleotide
gaagacttagcaggttcacaagctgcaagtcagtccgctagtagctcggctagtcaggcttctgctagctcttttgcacaggcttcctccgcttcccttgcagccagttcatcttttagtagtgctttttcaagtgcaacatccttaagtgccttgggcaatgttgcttatcaactgggtttcgacgtcggtacaaacctaggtttgacaaatgcagccggtctagctgctgccttctctcaagctgcctcctcagtaggtgttggtggttcatctggagcttatgccaacgctttgtcgaatgccgcggcacaatttttgtcggctcaaggtatcttaaacacggtcaatgctggttctttagcctcttcttttgcatccgctctttcgtcagtcgcagcatctgctgctgcccaggccagttcacaatctcaagcagcttccagcgcgttctcacgagcagcaagtcaatcagcttcacagagtgctgccaggtctggagctcaatcttccagtagtacaacaactacttcctcctcaggtacgtcttc

SEQ ID NO: 690 - DNA, 563 bp, Artificial Sequence
  Description of Artificial Sequence: Synthetic polynucleotide
gaagacttagcaggtaatgttgcctatcagcttggatttaatgttgccaacaccttgggattaggtaacgctgcaggattaggtgccgcattgtcacaggctgtatcttcggtgggtgtaggagcctcttcaggtacttatgccaatgctgtttcaaatgctgtgggacaatttctcgccggtcaaggcattttgaacgctgcaaacgctgcgagccttgccagttcttttgctagtgctctaagtgcttcagccgcttctgttgctagctcgagcgcagctcaatcagcgagtcaatcccaagccgctgcatcggccttctccagagcagcatctcaatcggcttctcagtcggcagccctttctggtgcacagagctcatcgacaacaacgacaacatctacaagtggctcgcaggccgcctcacagagcgcatcatctagtgcaagtcaagcgtccgcttcgtccttcgcacaagctagttcggcttcactcgcagcttcgtcatccttttccagtgctttctcgtctgctaacaccttgtctgcattaggtacgtcttc

SEQ ID NO: 691 - DNA, 563 bp, Artificial Sequence
  Description of Artificial Sequence: Synthetic polynucleotide
gaagacttagcaggtaacgtcgcctatcaattgggtttcaacgttgcaaatacattgggacttggaaacaccgcaggcctgggtgctgctctgtcacaagcagttagtagtgtcggtgtcggagccagttccgctacctacgcgaacgcagtttctaatgccgttggtcagtttttggctggtcagggtatcctaaatggcgctaatgctgcatcattggctagtagctttgccagcgccttgtctgctagcgcagcttctgtagcttcgtcgtctgccgcccaatctgcaacccaaagtcaagctgccgcttcggccttttccagagctgcttcacaatccgcttctcaatccgcagcaaggagcggcgctcaaagtagttccactacaaccactagctcaaccagcggatctcaggcagcttcacagtccgcatcgagttctgctagtcaggcttccgcttcgtctttcgctcaggctagtagtgctagtctggctgcgtcaagttccttttcttctgctttcagttcggccaatacactgagcgcactaggtacgtcttc

SEQ ID NO: 692 - DNA, 563 bp, Artificial Sequence
  Description of Artificial Sequence: Synthetic polynucleotide
gaagacttagcaggtaacgtggcttatcaacttggtttcaacgtcgcaaacacacttggacttggaaatgctagcggattgggtgcagctttgagccaagccgtttctagtgttggtgtgggtgcatcttctggtacttatgcgaatgctgtttcaaatgctgtgggccagttcctggcaggccagggtattttgaatggtgctaatgctgcttctttggcttcttcattcgcttcagcattgagtgcttcagccgctagtgtagcttcatcatctgctgcgcaatcagcatcacagtctcaagctgccgcatcagcattttccagggctgcatctcaatctgcatcccagtcggcagccaggagcggtgctcaatccagcagtacgaccacaacttcttccacgagtggtagtcaagccgcttcccaatccgcatcatcctcggctagccaggccagtgcttcctcctttgctcaagcctcctctgcctccttagccgcttcaagtagtttttcgagtgtgttttccagtgcaaacacgttgagcgctctaggtacgtcttc

SEQ ID NO: 693 - DNA, 563 bp, Artificial Sequence
  Description of Artificial Sequence: Synthetic polynucleotide
gaagacttagcaggttcattagcatcttcattcgctagcgcattatcggcatccgcagcatccgtcgcaagttctgcagcagctcaggctgcaagtcagtctcaagccgcagcctctgcattctctagggctgcctcccaatcagcttctcagtctgcagcaagatctggcgctcaatcatcctcgaccactaccacaaccagtaccgctggatctcaagctgcttctcaatttgcatcctccgctgcatcacaagcctcagcatcgtctttcgcacgagcttcctccgcctcattagcagcaagcagcagcttttcgagcgctttcagctccgcaaattccctatcagctttgggaaacgtaggttatcagctgggctttaacgtcgctaacaatcttggtataggaaatgcagctggtcttggaaacgcactgtcacaagccgtgagtagtgtcggcgtcggagcgtccagttcctcatacgccaatgctgtcagtaatgctgttggtcagttgttagccggacagggcattctaaatgccgctaacgcaggtacgtcttc

SEQ ID NO: 694 - DNA, 563 bp, Artificial Sequence
  Description of Artificial Sequence: Synthetic polynucleotide
gaagacttagcaggttcattggcatcttcattcgcttccgccttatctgcttctgcagcctcggttgcaagttcagccgccgcccaagccgcatcacagagtcaggccgcagcatcagctttcagcagggctgctagtcaatctgccagtcaaagcgcagccagatctggcgcacaatcaatttccacgacaaccactacatcaactgccggcagtcaagcagccagtcagtctgcatcatcagcagcttcccaagctagtgcctcatcattcgcgcgagcatctagcgcatcactagctgcatcgtcatcattctctagtgccttcagtagcgctaactctctatcagctctgggtaatgtaggctatcagttgggattcaatgttgccaacaatcttggtatcggtaatgcagcaggtctaggaaacgcattatctcaggccgtcagcagtgttggagtaggtgcctcttcttctacgtatgcaaatgctgttagcaatgctgttggacaattcttggcaggacaaggcattttgaacgcagctaatgcaggtacgtcttc

SEQ ID NO: 695 - DNA, 563 bp, Artificial Sequence
  Description of Artificial Sequence: Synthetic polynucleotide
gaagacttagcaggtagtctggctagctcctttgctagtgctttatctgcgtcggccgcatcagtggcctcatccgcagcagcacaggctgcttctcaaagtcaggccgcggcatccgcattttcacgtgctgcgtctcaatctgcatcacagtccgcagcaaggtcgggagcacaaagtagttcaacaactaccacaacttctaccgctggttcgcaggccgcatcccaattcgcatcttcagctgctagccaagcctctgctagttcattcgcgagggcatcatcggcctcactggctgcatcatcttcgttctcttctgcattttcttccgcaaattcactgtcggctctgggtaacgtcggttaccaattgggcttcaatgtagctaataacttgggaatctcaaatgccgcaggattgggtaacgctttatcacaggccgtttcttccgtcggagtaggcgctagttcttcctcttatgccaacgcagtttccaatgcagtgggtcagtttttggctggacaaggtatcttaaacgcagctaacgcaggtacgtcttc

SEQ ID NO: 696 - DNA, 563 bp, Artificial Sequence
  Description of Artificial Sequence: Synthetic polynucleotide
gaagacttagcaggttccctagcatcatcttttgcttctgccctgtctgcttctgctgcttcagttgcttcatctgcggccgcacaagcggccagccaaagccaggcagctgctagtgctttttctagagctgcttcacaatccgcttctcagtctgccgcgagatcaggcgcccaatccttttcaacaactacaacgacttcaaccgctggatcacaagcagcttctcaatcggccagtagcgcagctagtcaagcctctgcatcctcctttgctagagcatcgagtgcttcattggctgcatcaagcgcattctcttcggcattctcgtccgctaattctttaagtgccttgggaaatgtggcataccagctaggtttcaatgttgccaatacactgggaatcggaaatgccgcaggtcttggcaatgctctgagccaagctgtttccagtgtaggcgttggcgcatcttccagcacctacgctaatgctgtctccaacgctgtgggccaattcttagccggccaaggagtactgaacgcgggtaacgcaggtacgtcttc

SEQ ID NO: 697 - DNA, 563 bp, Artificial Sequence
  Description of Artificial Sequence: Synthetic polynucleotide
gaagacttagcaggtaacgttggttatcaattaggtttcaatgtggccaatacgctcggaattggaaacgctccaggattaggtaacgctttgtctcaagcagcctcctctgtaggtgttggagctagttccagtgcttacgctaacgctgtatctaatgctgtgggccaattccttgcgggtcaaggagttttaaatgcaggaaacgcaggtagtctggcttcttcatttgctaacgctctaagcgcttccgcggcaagtgtcgcatcaagcgcagcagcccaaagtgcatttcaaagtcaagctgccgcaagcgctttttctcgagctgcttcacaaagtgcttctcgtggtgcggctcgttctggagctcaatcttcttcaactacaacaactaccagtacgtcaggttcacaggccgcttcacaatctgcatcctcagctgccgcccaagctagtgcatcctccttcgctcaagcctcgtctgcttccttggcagccagttcagcattctcctctgcatttagttctgcaaatagtctgagtgctctaggtacgtcttc

SEQ ID NO: 698 - DNA, 563 bp, Artificial Sequence
  Description of Artificial Sequence: Synthetic polynucleotide
gaagacttagcaggtaatgttggttatcagttgggcttcaatgtcgctaacacgctcggaataggtaacgcaccaggacttggaaacgccttatcccaagcggtatctagtgtaggtgttggtgctagtagttccgcctatgctaatgctgttagtaatgccgtgggacagtttttggccggacaaggagttttgaatatcggtaatgctggttcgttggcctcttcattcgccaatgctctgtctgcaagcgctgcttccgttgcaagctcagctgcagcccagtcagcctctcagagccaggcagctgcaagtgcattctccagagccgcatcacaatctgcttcgcgaggagcagcacgttcgggagctcaaagcagttccacaactacaacaacttctacatccggttcgcaagctgcttcccaaagcgcatcaagtgctgccgcccaggcctccgcgtccagttttgctcaagccagctcggcttcactcgctgcctctagcgctttttcctctgcctttagcagcgcaaactcactcagtgcgttaggtacgtcttc

SEQ ID NO: 699 - DNA, 563 bp, Artificial Sequence
  Description of Artificial Sequence: Synthetic polynucleotide
gaagacttagcaggtaacgtcggataccaactaggtttcaatgtggctaataccttaggaatcggaaacgccccaggattgggaaacgctttgagtcaggctgtttcatctgttggagttggtgcatcatcatctgcctatgctaacgcagtcagcaatgctgtaggacagtttttagctggccagggagttcttaatattggaaacgcaggtagtctggcatcatcgtttgccaatgccttgtctgcatctgccgcctctgtggcttcttccgctgccgcacaaagcgcttcacaatcccaagccgccgcgtcggccttctcaagagccgccagtcaatccgcttctagaggtgctgcaagatcaggtgcccaatcttcgtcaactactactaccacttccactagtggatcacaggcagctagtcaatcagcatcgtcggctgctgcacaagccagcgcttcgtctttcgcccaagctagctccgcttctctcgcagcctcatccgctttttcgtctgcattctcttcagcaaattctttgtcggcactaggtacgtcttc

SEQ ID NO: 700 - DNA, 563 bp, Artificial Sequence
  Description of Artificial Sequence: Synthetic polynucleotide
gaagacttagcaggtaatgtcggctaccagttaggattcaatgttgctaacacattgggtatcggaaacgcacctggtttaggaaatgcattatctcaagcagtttcgagtgttggagtgggagctagctcaagagcttacgctaatgcagtttctaacgcagtgggacaattccttgctggacagggagtcttgaatgtcggcaacgctggctccttggcttcatcgtttgcaaatgctctttcggccagtgcagcttctgtggccagtagcgctgctgctcaatcggcttctcaatcacaggcagccgcctcagctttctcgagagctgcttcccaatcagcttccagaggagctgctagaagtggtgcacagtctagttcaacaactactacaacgagtacatctggctcacaagccgcctctcagtccgcttcctccgctgccgctcaggctagtgcttcatcatttgcacaggcgtcctctgcttctctggctgcgtcctcagccttctcatccgctttttcatccgcaaattctttgtcagctttaggtacgtcttc

SEQ ID NO: 701 - DNA, 563 bp, Artificial Sequence
  Description of Artificial Sequence: Synthetic polynucleotide
gaagacttagcaggtaacgtgggctatcagcttggttttaacgtcgctaacacattaggaataggtaacgcgccaagtttgggaaacgcactgtcacaagctgtctcttctgtaggagttggagcttcctcttcagcatacgctaacgcagtttccaacgctgtcggtcagtttctagctggtcaaggtgttttgaatgctggaaatgctggttctttggcctctagttttgctaatgcactgtcggcttcagccgcctctgttgcatccagcgctgctgcccagtcggcatttcagtcccaagccgccgcctcggctttttccagagcagcaagtcagtccgccagtcaatccgccgctcgttctggagctcaaagttcttcaacgaccacgactaccagtacatccggatcccaagcagcttctcaatctgcaagttcggctgccgcacaagctagtgccagcagtttcgcacaagcatcgtctgcctctctagcagcgagctcagcattctcctccgcttttagttcggcaaacagtttaagtgcattaggtacgtcttc

SEQ ID NO: 702 - DNA, 563 bp, Artificial Sequence
  Description of Artificial Sequence: Synthetic polynucleotide
gaagacttagcaggtaatgtgggttatcagctaggttttaatgttgctaacacattaggtattggaaacgcaccaggacttggtaatgctttgtcacaagcagtatcttccgttggagtaggtgcatcttcatctgcttatgctaacgctgtgagtaatgctgtaggtcagttcttggccggacaaggtgtattgaatattggtaacgcaggttcgttagcctcatcctttgcgaatgctttatcagcttctgccgcatctgttgcttctagcgcagcagcacaatctgcctcccaatcccaggctgcagcttcggcattttcaagagcagcctcccagagtgcttctcgaggtgctgctagatccggagcccaatcttctagcacgactactaccacaagtacttcaggaagccaagcagcctcacaaagtgcctcgagcgccgccgctcaagcatctgcatcttcctttgctcaagcttcgtcagcctcactagctgcttcatccgcattctcatctgccttcagttcagccaatagtttgagcgctctaggtacgtcttc

SEQ ID NO: 703 - DNA, 563 bp, Artificial Sequence
  Description of Artificial Sequence: Synthetic polynucleotide
gaagacttagcaggtaacgttggttaccagttgggattcaatgttgctaacactttgggtatcggaaacgctccaggactaggaaacgctttgtcacaggccgtctcttcagtaggagtcggtgcgtcctcatctgcttacgcaaatgcagtctcaaacgcagtcggacaattcttggctggtcaaggagttcttaacgccggtaatgcaggaagtctcgccagttctttcgccaatgccttatcagctagtgctgcaagcgtcgcaagtagcgcagctgcccaatcggctttccaatcacaagccgcggcaagtgcattctctagagcggcctcacagtcagccagtcagtctgctgctcgctcgggtgctcaatcttcttctactactacaaccacgtctacttccggtagtcaagcggccagccagtctgcttcgtctgcagctgctcaggcgagtgctagtagttttgcccaagcgagtagcgcttcgttagccgcatcttctgcctttagcagtgctttctcctcagcgaactccctttcagctctaggtacgtcttc

SEQ ID NO: 704 - DNA, 563 bp, Artificial Sequence
  Description of Artificial Sequence: Synthetic polynucleotide
gaagacttagcaggtaacgttggttatcaattgggttttaatgtggcaaacacactcggcataggaaacgctccaggtttgggaaatgcattatctcaggccgtatcttccgttggtgtgggtgcatcctccagtgcatacgctaatgctgtctctaacgcagtaggtcagttcctggctggtcagggtgtcttaaacattggtaatgcaggttcattggcttcctcgttcgccaacgccttgtcagctagcgccgctagtgtcgcgtccagtgctgctgcccaaagcgcatcacaatcacaggcggctgcatccgctttctcaagggcagcttctcagtctgcatctagaggtgctgcacgttctggtgcacaatcctcttccacaacaacaactactagtacatccggatcccaagctgcttcacaatccgcatcttcagccgccgcccaagcatcagcttcttcctttgcccaagctagtagcgcttctttagctgcgtcgtctgcttttagttcggctttcagcagtgcgaattctttatctgcactaggtacgtcttc

SEQ ID NO: 705 - DNA, 563 bp, Artificial Sequence
  Description of Artificial Sequence: Synthetic polynucleotide
gaagacttagcaggtaatgtaggataccaattaggtttcaacgtcgctaatacgctaggtattggtaacgctccaggcttgggaaacgccctgtcccaagccgtttcttcggtaggagtaggagcctcatctagagcatacgcaaacgccgtaagtaatgcagttggtcagttcttggccggtcaaggtgttctgaatgccggaaacgcaggaagtctcgcttcgagtttcgccaatgctttgtctgcctctgctgcctctgttgcgagttcagctgcagcccagtctgccagccaatctcaagctgcagcttccgcctttagcagagctgcatcacagtcagcatcccaatccgcagccagatcaggtgctcaaagctccagtaccactacgactacttcagcctccggatctcaagccgcatctcagagcgccagtagcgctgccgcgcaagctagcgcctcttcatttgctcaggcctcaagtgcctcccttgccgctagctcggccttttcttctgctttttcaagtgctaactcgctgtctgcgttaggtacgtcttc

SEQ ID NO: 706 - DNA, 563 bp, Artificial Sequence
  Description of Artificial Sequence: Synthetic polynucleotide
gaagacttagcaggtaacgttggttaccaattgggtttcaacgttgctaacaccctgggtataggaaacgctcctggtcttggtaatgctctctcccaagctgtatcgtcggtcggagtaggagcttcatcaagtgcctatgcaaatgcagtctcaaatgctgtcggacaattcttggcaggtcagggcgttcttaatgcaggtaatgccggatcgttggccagcagcttcgctaacgctctttccgcttcggccgcttctgtggcatcctctgccgctgcacaaagtgcctttcaatcacaagcggccgctagtgcatttagtcgagctgcttctcagagtgcgagtcagtcagctgcaagaagtggtgctcagtcatcttctactactacaactacgtctacttcaggctctcaagctgcctctcagtccgcatcgtctgctgccgctcaagcatcagcgagtagctttgcgcaagcatcatccgcgtcacttgctgcctcaagtgcttttagtagtgccttctcttccgctaattcattgtccgccttaggtacgtcttc

SEQ ID NO: 707 - DNA, 563 bp, Artificial Sequence
  Description of Artificial Sequence: Synthetic polynucleotide
gaagacttagcaggtagtcttgctagctcttttgcatccgctctttcagcttcagctgcatcagtggcaagttctgccgctgctcagagtgcttctcaaagtcaagctgccgcttcagccttcagcagggctgcttcacaatcagcctcacaaagcgcagcaagatcaggtgcccaatctagtagtaccaccacgactacatctgcttccggttcacaagcagcttcgcagtctgcttccagtgccgcaagtcaagcaagtgcctcgtcattcgctcaagcgagctctgcttcgttagctgcttcatctagcttttctagcgctttttcatcagctaattcgttgtccgctctgggaaatgttgcttaccagctgggatttaatgttgctaacacacttggaattggaaatgctccgggactgggcgcagccttatctcaagcggtttccagcgttggtgtgggtgctagtagcagtacctatgcaaacgtggtcagcaatgctgttggtcaattccttgctggacagggagttctgaacgctgctaatgcaggtacgtcttc

SEQ ID NO: 708 - DNA, 563 bp, Artificial Sequence
  Description of Artificial Sequence: Synthetic polynucleotide
gaagacttagcaggtagcttggcaagctctttcgcctcagctctgtccgcatccgctgcttcagtcgctagctcagcagctgcacagagtgcttctcaaagtcaagctgcagcctctgccttcagtagagccgcttcgcagagtgcatctcagagtgccgcgaggtctggagcacaatcttccagtactacaacaactacgtctgcttccggatcacaagccgcctcgcaatccgcctccagtgctgcgtcacaagcttcagcttcttcatttgcacaggcctcctctgcatctctcgcagcttcctcttcgttctcttcagcattttcttcggctaacagtttgtctgctcttggtaacgtcgcatatcaactcggtttcaacgttgctaacaccctaggtattggtaatgcaccaggactcggtgccgccctttcacaggcagtgagctctgtcggcgtcggtgcatcatcaagtacttacgccaatgtcgtgtctaatgctgtgggacagtttttagcaggacaaggtgtcctgaatgctgcaaatgcaggtacgtcttc

SEQ ID NO: 709 - DNA, 563 bp, Artificial Sequence
  Description of Artificial Sequence: Synthetic polynucleotide
gaagacttagcaggttctcttgcttcgagctttgctagtgcattgtccgctagcgctgcatccgtcgcttcttctgctgcagcacaatctgcatcacaaagccaagctgctgcttctgctttttctagggctgcttctcaatcggctagtcagtcagctgctagaagtggagctcaatcttcgtctaccacgactactacctcagcatccggtagtcaagcggcctcacagtccgcatcatcagccgcttcccaagcttccgcatcgtcattcgcccaggcctcgagcgcctctttggccgctagcagttcgttttcttccgcattctcctccgcaaactctctaagtgctcttggaaatgttgcataccaattgggatttaatgttgctaacactttgggaattggcaatgcgccaggattgggagctgcattatctcaagcagtgtccagtgtcggtgtgggagcttcatcaagcacttatgctaacgtggtttctaacgcggtaggccaatttctcgcaggtcaaggtgttttgaatgctgctaatgcaggtacgtcttc

SEQ ID NO: 710 - DNA, 563 bp, Artificial Sequence
  Description of Artificial Sequence: Synthetic polynucleotide
gaagacttagcaggttctctggcctcgagctttgcctccgcattaagcgcttccgcggcttcagtggcttctagtgccgccgcccagagcgcttcccagagccaggccgctgccagtgctttttcgagagctgctagccaatcagcatcacagtccgcagcgagatccggtgcacaatcttctagtactactaccactacctctgcaagtggatctcaagccgcttcccaatcggcctcttctgctgccagtcaagcatcagcgtcgtcttttgcccaagcttcctctgctagtttagcagcctcgagcagcttctccagcgcattttcttctgctaattcactttcagctttgggtaacgtagcctatcaattgggttttaacgttgctaacacacttggaataggtaacgcacctggtctgggtgcagccctgtctcaagctgtgagctccgtgggcgtcggtgcctcgagttcaacctatgcaaacgtagtatctaacgccgttggacaattccttgccggtcaaggagtacttaacgcagctaatgcaggtacgtcttc

SEQ ID NO: 711 - DNA, 563 bp, Artificial Sequence
  Description of Artificial Sequence: Synthetic polynucleotide
gaagacttagcaggttctctagcttcttctttcgcgtccgctctcagtgcttcggccgccagtgttgcaagctcagctgccgctcagtccgcaagccagagccaggctgcggcaagtgccttttctcgagctgcttcccaatctgcaagtcagagtgctgcacgaagtggagcacaatcatcgtctactaccacaactacttctgctagtggatcccaagctgcttcacaatcggctagttcggctgcatctcaagccagtgcgtcctcattcgcacaggcctcgagcgcttcattagcggcatccagctcattctcgtctgcatttagctccgctaatagtctgtctgctcttggaaatgttgcctaccaacttggattcaacgtagccaatacactgggaataggcaacgctcctggcctcggtgctgctctgtcacaagcagtttctagcgtaggtgtaggtgcttcttccagcacctatgctaatgtggtgtcaaatgctgttggacaattcctggcaggacaaggtgtgctgaacgccgctaatgcaggtacgtcttc

SEQ ID NO: 712 - DNA, 563 bp, Artificial Sequence
  Description of Artificial Sequence: Synthetic polynucleotide
gaagacttagcaggtagcctcgcatcttcctttgctagcgctctgagtgcctcggctgcaagtgttgcatcaagtgcagccgcacagtctgcttcgcaaagccaagctgcggcctctgcattttccagagcagcatcacaatccgctagccaaagcgctgctaggtccggtgcacaatcatcttcaactactaccaccacttcagcttccggctctcaagctgcatcacagagcgccagttccgccgcctcgcaggcttccgcatcatctttcgctcaagcctcgtccgcttccctagccgctagctcatccttctcaagtgctttttcctccgccaattctctttcagctttaggaaacgttgcttaccaattgggttttaacgtagccaacacacttggcatcggaaacgcacctggtttgggtgctgctttaagtcaagccgtttccagtgtcggtgtgggagctagttcgagcacgtatgctaatgtggtttcgaacgccgtcggacaatttttagcgggacaaggtgttttgaatgcagctaacgcaggtacgtcttc

SEQ ID NO: 713 - DNA, 563 bp, Artificial Sequence
  Description of Artificial Sequence: Synthetic polynucleotide
gaagacttagcaggttcattagcatctagctttgcatctgcactctccgcttcagctgcctcggtggcctcgtccgctgcagcccagtcagctagtcaaagtcaggctgcagcttctgccttttctagggctgcatctcagtcgggtagccagagtgccgctcgatctggtgctcaaagctcgagtactaccacaacaacaagtgctagtggatctcaggccgcgagtcaatcagcatcgtctgccgcttcacaagcttcggcttcttcttttgcgcaagctagctcggcttccttggctgcttccagctccttcagctccgcattttcaagcgctaatagtctctcggctttaggaaatgttgcctatcaactcggtttcaatgtggctaacactttgggtataggtaatgctccgggattgggagcagctttatcgcaggccgtctcttctgtaggagtaggcgcttctagctctacatacgctaacgttgtcagtaacgcagttggtcagtttttggctggacagggagtgttaaatgctgctaatgcaggtacgtcttc

SEQ ID NO: 714 - DNA, 563 bp, Artificial Sequence
  Description of Artificial Sequence: Synthetic polynucleotide
gaagacttagcaggtagtttggcttcttcatttgcttcggcattgagcgcgagtgcagcttcagtcgcttcgtcagctgccgcacaatcagcctctcagtcacaagctgctgcatccgccttttcccgagctgcttcgcaatcagcaagccaatcagcagcaaggtcaggagcgcaaagtagctctactactaccaccacatcagcatcaggttcccaggccgcaagtcaatccgcaagctccgcagctagtcaggcatcggcatcttccttcgcacaagcttcttctgcttccttggccgcctcttcatcattttccagtgcgttctccagcgccaactccctatcagctctcggtaacgttgcttatcaactgggtttcaacgtagcgaacactcttggcataggtaacgcacctggattgggagcggcattgtctcaggctgtttcttctgttggtgtaggagcatcctcctccacttatgctaatgtcgtctccaacgctgttggacagtttttagctggtcaaggagtactaaatgcagctaacgcaggtacgtcttc

SEQ ID NO: 715 - DNA, 563 bp, Artificial Sequence
  Description of Artificial Sequence: Synthetic polynucleotide
gaagacttagcaggtagtttggcctctagttttgctagcgctttgtccgctagtgctgcctctgttgcatcgtcagctgcagcacaatcagcgtctcaatcccaggcagcagctagtgcattttctagagcagcctcacaaagtgcttcccaaagtgccgccaggtcgggagctcaatcatctagcaccactacaacaacttctgcttcgggatctcaggccgcatcccagtccgcttcctccgccgcatctcaagcttctgcctcttcatttgcccaggcttcatctgcatcattggctgcttcgtcctccttttcatccgccttttctagtgctaactccttgtcagcacttggaaacgttgcttaccaactaggatttaatgtagccaatacacttggcataggaaacgcccctggattaggagcggcattatcacaggctgtctctagtgttggagtgggagcttcaagctctacgtacgcaaacgttgtctccaatgccgttggacagtttttggctggtcaaggagttttaaatgcagctaacgcaggtacgtcttc

SEQ ID NO: 716 - DNA, 563 bp, Artificial Sequence
  Description of Artificial Sequence: Synthetic polynucleotide
gaagacttagcaggtagtcttgcaagctcatttgccagcgcactgtctgcttctgccgcttcagttgcatcaagcgctgcagctcagagcgcatctcaaggacaagctgctgcttccgcattctctagagcagccagtcaaagcgcctcgcagtctgctgcaagatctggtgctcaatcatcaagtacgacaacaacgacttcagcgtcgggaagtcaggccgcttctcaatctgcttccagtgctgcctcacaagcctcagcttcgagcttcgcccaagccagttccgcctccctggcagcttcttctagcttttccagcgctttctcttcagctaattctctaagtgcgctgggaaatgttgcttaccaattgggtttcaacgtagccaacacactaggtatcggaaacgcaccaggtctaggtgcagctttatcccaagcagtttcaagtgttggtgtcggtgcttcttcctcaacctatgccaacgtagtctcaaatgccgttggtcaatttctggccggacagggcgtgctgaatgccgcaaatgcaggtacgtcttc

SEQ ID NO: 717 - DNA, 602 bp, Artificial Sequence
  Description of Artificial Sequence: Synthetic polynucleotide
gaagacttagcaggttcggcgacaagctctactaccacgactactaccgtttccaaatccgctgctgctgcagctgcagcagcagctgctgcaagttcagcctcgtctgctagtagagattctgatcgatctagtaccgctgcggaggcttacgcttctagcagtgcttacgccagtagcaatttcgaaaactacttggctagcgacttgtctaattctgatgagttcgaatcggtatatggctccttatactcctccgcagacgcagcctcgtacgcaagatcttctgcagaatacgcctcgaacacgttaggtctttctaaggaaacatcgtatgccctggcatcagctgcggctaaagcagttagcgaatccggatcaggatcatccagttacgccagagcttacgccgtagctaaatcctctgctgtggtcttgcaaaactctggtgtacttagcagttctaactccagaagtttgtcgtcagcttttgccaaggctttcgcatcttcttccgcgagtagctatgcttcgtatcagtctaggaacacaggtacaagtagggcatcatctgctggttctggtgcagcaggtacgtcttc

SEQ ID NO: 718 - DNA, 602 bp, Artificial Sequence
  Description of Artificial Sequence: Synthetic polynucleotide
gaagacttagcaggttccgcgacctcatccactactacaaccacaacagtttccaaaagcgctgctgccgcagcagcagctgcggctgccgcttcctccgctagttccgctagtagagactcggatagaagtagtaccgcggctgaggcgtatgcctcttcctcagcttacgcctctagcaattttgaaaattatttagcatccgatctatcgaactcagatgagtttgagtcagtgtacggatccgtctattcatcctcggacgctgcctcttatgcaagatcgtctgccggttacgccagtaacacccttggattgtccaaagaaacgagttacgctctggcctccgccgctgctaaagcggttagtgagtctggaagtggatcttcttcttatgctagagcgtacgctgttgctaaatcttccgctgctgttttgcagaactcgggagtcttgagctctagtaacagtcgtagcttgagtagtgcatttgctaaggcttttgcttcctcttcagcaagttcttatgcctcgtatcagtcacgtaatacaggaacttcacgagcgtcatccgcaggctcgggcgctgcaggtacgtcttc

SEQ ID NO: 719 - DNA, 602 bp, Artificial Sequence
  Description of Artificial Sequence: Synthetic polynucleotide
gaagacttagcaggtagcgccacttcttccactacaactactacgacagtatctaaatcggctgccgcagctgctgcagctgccgctgccgcttctagcgccagcagcgcctctcgtgattcagacagatcttcgactacggccgaggcctacgcatcttcgagcgcttatgcctcaagcaattttgaaaactacctagctagcgatctttcgaattctgacgagtttgaatcggtgtacggaagcgtgtattcgtctagtgatgcagccagttatgctcgttcatccgcaggttatgcttcaaatacactcggactgtccaaggaaacttcctacgcacttgcctctgctgccgcgaaagctgtttctgaaagtggttccggaagttcttcatatgctcgcgcatatgcagtggccaaaagttccgccgtagtattgcaaaattctggtgtcctaagctctagcaattcgcgatctttatcctcagcatttgctaaggcctttgcgtcgagtagtgcctcctcctacgcgtcctacaaaagtcgtaacacaggtacgtctagggcaagcagtgctggtagtggtgctgcaggtacgtcttc

SEQ ID NO: 720 - DNA, 602 bp, Artificial Sequence
  Description of Artificial Sequence: Synthetic polynucleotide
gaagacttagcaggtagcgcaaccagttccacaaccactactacaacagttagtaaaagcgctgcagctgccgctgctgcggctgctgctgccagttccgcatctagtgcttccagagactccgatagaagctctactgctgccgaagcttacgcttcttcctccgcttacgctagctcgaattttgaaaactacctggcaagtgatcttagcaattcagatgaattcgaaagtgtatacggatccttgtattcaagtagtgacgcagcttcttatgcgcgttcatccgctggttacgcctccaatacactgggactttccaaagaaacatcttacgcgttggcttctgctgccgctaaagcagtgtccgagtccggatctggtagtagttcatacgcgagggcttacgctgtggctaagtcctcagccgtagtcttgcaaaactctggtgttctatcatctagtaactctagaagcctctcatctgccttcgcaaaggctttcgcctcttcctcggcatcatcatatgcttcatataagtcaaggaatactggcacctcgcgtgctagctctgctggaagtggagctgcaggtacgtcttc

SEQ ID NO: 721 - DNA, 602 bp, Artificial Sequence
  Description of Artificial Sequence: Synthetic polynucleotide
gaagacttagcaggttcagcgacttcgtctacaactacgaccaccacagtttctaaatctgcagcagcagctgccgcagctgcagctgctgctagtagcgctagctcggccagaagggattctgacagatcctcaagtacagcagaagcctacgcgtcctcatctgcttatacgtcatctaattttgagaactatctagccagtgatttgagtagctccgacgagtttgagtccgtttatggatctctctacagtagttcagatgccgcttcgtacgctcgatcgtctgctgaatatgccagtaataccctgggtctgtctaaagagacaagttatgctctcgcttctgcggccgccaaagctgtttcagaaagcggttctggctcatcgagttacgctagagcttatgccgtggccaaaagctctgccgtggtgttacaaaattcaggagttttgtcaagctcgaattcaagaagtttatcgtctgcatttgccaaggctttcgccagctcttccgcatcatcatacgcttcttacaaatctagaaataccggtacttccagagcctcctcagctggctcgggagctgcaggtacgtcttc

SEQ ID NO: 722 - DNA, 602 bp, Artificial Sequence
  Description of Artificial Sequence: Synthetic polynucleotide
gaagacttagcaggtagtgctacttcgtcaacgacaacaactacaacagtttccaaatcagctgcagcggccgctgccgctgctgcggctgcttcctcagctagctctgctagcagagattcagaccgaagttctactgctgcagaggcatatgcttccagttctgcatacgcttcttcgaatttcgagaactatttggcctcggatttgtcgaactcagacgagtttgagtccgtatacggttctttgtactcctccgcagatgctgcatcttacgctagctctagttctgaatatgcatcaaataccctcggtctatctaaggaaacctcgtatgctcttgcatcagctgctgctaaggctgtgtcagaatccggaagtggctcctcttcctacgcaagagcatatgccgtggccaagagctctgccgtggttttaaggaactcaggtgttctttcctcatcaaactccagatccctttcgtccgcatttgcgaaggcattcgcttcatcctctgcatcaagttatgcatcatataaaagtagaaatacaggcacctccagggcatctagtgcgggctcaggagccgcaggtacgtcttc

SEQ ID NO: 723 - DNA, 602 bp, Artificial Sequence
  Description of Artificial Sequence: Synthetic polynucleotide
gaagacttagcaggttcagcaacctcatcaactacaacaacgaccactgtgtctaagtctgctgctgcagctgctgcggcggccgcagccgctagttctgcatcgtccgctaggagagattctgatagatcttcaagcaccgccgaagcatatgctagttcctctgcttacacctcttccaattttgaaaattacctcgcttccgacttaagttcctcagatgaattcgaatccgtttatggtagtctgtattctagttctgacgctgcttcttatgctagaagctctgcggaatacgctagcaacactttgggtttatcaaaagaaacatcttacgctttggccagtgctgctgctaaggccgtctcagaaagtggatctggtagcagttcttacgccagagcctatgctgtagctaagtcatctgctgtagtcttgcagaactccggagtcttgtcgagcagtaacagtagatcattgagttcagcttttgcgaaagcttttgcatcctcttcagcttcatcctacgccagctcaaaatcaaggaacacaggaacctcccgagctagtagcgcaggttccggagctgcaggtacgtcttc

SEQ ID NO: 724 - DNA, 581 bp, Artificial Sequence
  Description of Artificial Sequence: Synthetic polynucleotide
gaagacttagcaggttcttttgcctctgcctcagcatacgctttcgcatttgctagcgccttttctcaagtcttatccaattatggtttgctcaatatcaataacgcttacagcttggcctcgagtattgctaacgcggcgagcgcttcagcatcatcagctgcagctgctgcagcttcatcttcttctgctgcagcggccgctgcagccgcttctggcgctgcaggtagcgcagctgcaacttcgaccactacatcgacatcgtcatctactgcagcagctgccgcttctgccgccgcttcagctgccgcctccgccagtggagccgccagagctgccggagcctcttccgccgcgtcagacgcttccgcatcaagcagtttacagcaatccttgggttcagcattggctcagtcatcttcctttgccgcagcctttgcccaggcaaactcagcagcatccgccgccgcaattgcatacgctctagcacaaatcgttgctaaccaaataggattttcatcttactcttcagctttcgctagtgcggcttcatcagccgtttcatcactaggtacgtcttc

SEQ ID NO: 725 - DNA, 581 bp, Artificial Sequence
  Description of Artificial Sequence: Synthetic polynucleotide
gaagacttagcaggtagctttgcatcggcctcagcttatgcatttgctttcgcctcagctttttcgcaagtcttaagtaattatggattattgaacatcagtaacgcctacagtctagccagttctattgcatccgctgctagtgcatctgcaagttctgccgccgccgctgcagcgtccagctctgcagctgctgctggtgccgccgcagcttccggcgctgcaggtagtgctgcatcaacgagtactacaacttcaactagtacaagtaccgcagccgcagctgcaagcgcagcagctgcagcagctgcttctgcatcaggtgcagcccgagcagctggcgcgtcctcagctgcttccgctgcatctgcttccagcagcctgcaacaatctttgggatctgccttagcacaaagttcttccttcgcagctgcatttgcccaagccaattctgctgcttctgcggctgccatagcctacgccctggcccagactgttgcaaaccagataggtttttccagctattcgtctgcatttgctaccgccgcttcttctgctgtttcctccttaggtacgtcttc

SEQ ID NO: 726 - DNA, 581 bp, Artificial Sequence
  Description of Artificial Sequence: Synthetic polynucleotide
gaagacttagcaggttcattcgcatccgctagtgcctatgcctttgcatttgccagtgcattttctcaagtcctgtcgaactatggattattaaatatttccaacgcctacagcttggcttcttcaatcgctaatgcagcttcggcttcagccagtagcgccgctgcggccgctgcatcatcttcctctgccgcagccggagcagccgcagcttcaggagcagccggctcggttgccgctacaagtactactactacggctagtacttcaactgccgcggctgccgcttctgccgctgctgcagctgctgcttctgcttctggcgccgctagggccgctggtgctagttcagctgcaagtgccgcctcagcctccagtagtttgcagcaatcactgggaagtgccttggctcaatcctcatcattcgccgccgcattcgcgcaagccaattcagcggcatctgctgctgctatcgcttacgctttggctcaaacagtggcaaaccaaattggattcagttcatactcctccgcgtttgcatcagcagctagctccgccgtttattcattaggtacgtcttc

SEQ ID NO: 727 - DNA, 587 bp, Artificial Sequence
  Description of Artificial Sequence: Synthetic polynucleotide
gaagacttagcaggtgccagcgcatctgcctacgctagcgctatctctaatgctgttggtccttatttgtacggtctaggactctttaaccaagccaacgcagcttcctttgcttcctccttcgcaagtgcagtcagttctgccgtcgcttcagcttccgctagcgctgcttcctcagcatatgcccagtccgctgccgctgcacaagcacaggcagcttcatctgccttttcacaggctgccgctcaatcagccgcagcagccattgctggagcaagtgctggtgctggagcgtccgctggtgcaggagcttcagcaggagcaggtgctgttgcagctagtcaggcagccgcatcttcatctgcaagtgccgttgcgtcagctttcgctcagtcagcctcatacgcactagcttcaagttctgcttttgccagcgcttttgcttccgcaacatcagccggttacttgggatctttggcgtaccaattgggtttaaccaccgcatacaatttgggtttaagtaatgctcaagctttcgcaaacactctgtcccaggctatcgttggagtaggagtaggtacgtcttc

SEQ ID NO: 728 - DNA, 620 bp, Artificial Sequence
  Description of Artificial Sequence: Synthetic polynucleotide
gaagacttagcaggtgcttctgccagtgcgtacgcttcggctattagcaacgccgtaggtccatatttatacggtttaggcttgttcaatcaagcaaacgctgcatctttcgcttcaagtttcgcaagtgcagtttcaagtgcagtcgctagtgcttcggcctctgccgcttcatctgcctatgcgcagtcagcagctgcccaggctcaagccgctagttctgcattctctcaggcagcagcgcagtccgccgctgcagcttctgcaggagctagtgccggagctggagcgtcagctggagctggtgcagttgccggagccggagcggttgcgggcgcaggtgccgttgcaggtgctagtgctgctgccgctagccaagccgctgcatcgtcatcagcatctgctgtggctagtgcttttgctcagtcagcttcctatgctctggcttcatcaagtgcgtttgctaatgcatttgctagcgctactagtgcgggttacttgggatccctggcctatcaattgggactgacgactgcatacaaccttggattgagcaacgctcaagccttcgcttctactctgtctcaagccgtgacaggagtgggcttaggtacgtcttc

SEQ ID NO: 729 - DNA, 641 bp, Artificial Sequence
  Description of Artificial Sequence: Synthetic polynucleotide
gaagacttagcaggtgcatcagcaagtgcttacgcatccgctatctcaaatgcagttggcccttacttgtacggattaggtctgttcaaccaagctaacgctgcgtcctttgcctcttccttcgcttcggcagttagttcggcagtcgcttcggctagtgccagtgctgcatcttcggcatatgcccaatctgctgccgctgcacaagcacaggctgcgtcgagcgctttttcacaggctgctgcacaatcggcggctgcggcttctgctggtgcatcggctggtgccggagcatcagcgggtgcaggagcttcagctggagctggtgcaagtgcaggcgcaggagctagcgccggcgctggtgctattgcaggtgctggagccgcagccacgagtcttgctgcagcctcctcatctgcttccgctgtagcttctgcttttgcacaatcagcatcttctgcattggcctcttcttccgctttcgctaatgcttttgctagtgccacctctgtctccgcactgaatagtatagcttatcagatgggtgtgtccgctgcaaatattttgggaataagcaacgcacaaggatttgcaaatgctttgagccaggctgtaggtgttgttggtgtaggtacgtcttc

SEQ ID NO: 730 - DNA, 575 bp, Artificial Sequence
  Description of Artificial Sequence: Synthetic polynucleotide
gaagacttagcaggtatacttactcaagaaaatgcagctggtttagcttcatccgtttcctccggtatatcaagtgcagcaagctcggtggcagctcaagcggcctcagctgcacaatcttctgcctttgctcagagccaggcggccgctcaagctttttcgcaggcagcctcaagatcagcgagccaatccgcggctcaagctggatcttcctccactagtacaacaactactacatcacaagctgcttctcaagctgcctcccaatctgcctcctcttcgtctagcgcagcttcacagagtgcttttagtcaagccagttcttcggctttagcttcgagttcaagtttctccagtgccttttcttcggcatcgtctgccagcgccgttggtcaagtaggataccagattggacttaatgcagctcaaactcttggtattagcaatgcaccagcgttggccgatgctgtttcacaggctgtcaggaccgttggagtcggtgcctcaccatttcaatacgcaaatgccgtctctaatgccttcggacagctcttgggcggacaaggtacgtcttc

SEQ ID NO: 731 - DNA, 575 bp, Artificial Sequence
  Description of Artificial Sequence: Synthetic polynucleotide
gaagacttagcaggtattttgacacaagagaatgcagccggactggcttcctccgtttctagcgctataagctccgccgcttcctcagtcgctgcccaagcagcctcagccgcacaatcttctgcttttgcacaaagtcaagctgcagcacaagctttttctcaagctgccagcagatcagcttctcagagtgctgcacaagctggaagctcaagtactagtactactaccaccacctcacaggctgcgtcgcaagctgcttcacaatcagcaagctccagctctagtgctgcctcccagagcgcattctcacaagcgagttcatctgcgttagccagtagctctagtttttcttcggctttttcttccgcctcgtccgcatccgctgttggacaggttggataccagatcggcttgaacgccgcacagacattgggaatttctaacgcaccagcccttgcagatgctgtaagtcaggctgtacgtacagtgggcgttggagcttccccattccaatacgctaacgccgtctccaacgcctttggccagttgttgggaggccaaggtacgtcttc

SEQ ID NO: 732 - DNA, 575 bp, Artificial Sequence
  Description of Artificial Sequence: Synthetic polynucleotide
gaagacttagcaggtatcttgactcaagaaaatgccgctggattagcctcttctgtgtcatcggccatttccagtgctgctagttccgttgcagcacaagctgctagtgcggcacaatcttcagctttcgctcaatcccaggcagctgcacaagcattttcccaggctgcatcgaggtctgcttcccagtctgctgcccaagcgggatcatccagcacttccacaacaaccactacatcacaggctgcaagtcaggcagcatctcaatcagcaagctcttcatacagcgcggcttcgcagtcagctttttctcaagctagctcatccgctttggcttctagttcttcgttctcctcagctttcagctctgctagtagcgcttctgccgttggtcaagttggttatcaaattggactgaatgccgctcagacattaggaatctctaatgcaccagcattcgctgatgccgtttctcaggctgttagaactgtcggagttggagctagcccattccaatatgctaatgctgtttcaaatgctttcggccaactgctaggaggccaaggtacgtcttc

SEQ ID NO: 733 - DNA, 575 bp, Artificial Sequence
  Description of Artificial Sequence: Synthetic polynucleotide
gaagacttagcaggtatcctgactcaagaaaatgctgcaggtttggcttcatccgtatcttctgctatttctagtgcagctagctcagttgcagcccaagcagcatccgcagcccaaagctcagctttcgcacagtctcaagctgctgcacaagctttttctcaagcagcctccagaagtgctagccaatctgcagctcaggctggaagttcatctactagtacgactacgacaacatctcaagccgcttcacaggctgcgagtcagtccgcttcatcttcctattccgctgctagccagtccgccttctctcaggcttcttcgtccgcattagcctcctcatcgtcattttcgtctgccttctccagtgcttcttctgccagtgcggtaggacaggtaggataccagatcggtttgaacgcagctcagaccttgggaatctctaacgcccctgcctttgccgacgcagtcagtcaggcggttagaacggtaggagtaggtgctagtccgttccagtatgctaatgctgttagtaatgctttcggtcaattgttaggaggacaaggtacgtcttc

SEQ ID NO: 734 - DNA, 575 bp, Artificial Sequence
  Description of Artificial Sequence: Synthetic polynucleotide
gaagacttagcaggtattctcacgcaagagaacgctgccggtctggcatcgagtgtcagttccgccatttcgtccgcagcatcttctgtggcggcacaggccgcttcagctgcacaatcatcagcttttgcccaaagtcaagcagccgcccaagctttatcgcaagcagcatctaggtctgcatcacagagcgcagctcaagctggctcgtcgtctacctccaccacgaccactacttctcaagccgcatcccaagccgcaagtcagagtgctagtagctcgtattcagcagcctcgcaaagtgcctttagccaagcctctagttcggccttagcatccagttcgtcgttctcaagtgcttttagtagtgccagcagtgcgtctgctgtcggacaagtaggttaccagattggcttaaatgctgctcagacactgggaatctcctccgctcctgccttcgccgacgctgttagccaggcggtcagaacagttggagtgggcgcttctccatttcaatatgcaaatgcagtctctaacgcctttggtcagttactgggaggtcaaggtacgtcttc

SEQ ID NO: 735 - DNA, 575 bp, Artificial Sequence
  Description of Artificial Sequence: Synthetic polynucleotide
gaagacttagcaggtattcttactcaggaaaacgctgccggtttggcttcttcagtttcttcggcaatttcgtctgctgcgtctagcgtagcatcccaagctgccagtgctgcacaatcaagtgcttttgcacaaagtcaagctgctgctcaggctctatcccaagcggcttctaggtcggcgtctcagagcgctgctcaagctggttcatcatctacctctaccacgacgaccacttcgcaagcagcttcccaggcagcctcacaatcagcatctagttcgtactcagctgcttctcaaagtgccttttcccaagcttcctcctccgcactagcaagttcatcaagcttcagttctgcatttagtagtgcctcttcagctagtgctgtgggtcaggtaggataccaaatcggtctaaacgccgcacagacacttggtatctccaatgctccagcctttgctgatgctgtgtcccaagcagtacgaactgttggcgttggcgcctcgccattccaatatgctaacgcagtgtctaatgccttcggtcaattgttgggagagcaaggtacgtcttc

SEQ ID NO: 736 - DNA, 536 bp, Artificial Sequence
  Description of Artificial Sequence: Synthetic polynucleotide
gaagacttagcaggtgttttgaatgctggtaacgcttcggctcttgctggttcttttgcaagagccttgtctgcaagcgctgaatcacagagttttgctcaatcacaagcttatcagcaggccagtgcttttcagcaagctgctgctcagtccgcagcacagtcagcttctagagctggcagcacctcaagttctacgacaacaactacttcgggagctacatctcaagcagcttctcaaagcgcatcttctagttattcgagtgcctttgcacaagccgcttcttcctccctcgcaacctcttccgccatttccagagcatttgcctcagttagttcagcctctgccgcaagtagtctagcttacaacataggactatcagctgctcgcagtttgggaattgcatccgataccgccctggctggtgcattggcccaggccgtaggaggtgttggtgcaggtgcttcagcgtcagcgtatgcaaacgctatagctagagccgctggacaattcttggcaacacaaggtacgtcttc

SEQ ID NO: 737 - DNA, 536 bp, Artificial Sequence
  Description of Artificial Sequence: Synthetic polynucleotide
gaagacttagcaggtattgcttccgatacagccttagctggagcattagctcaggcggttgccggtgttggtgctggagcttcggctagcacatacgccaacgtcatagccagagccgcaggacaattcttggcaacacagggcgttttagatgctggcaatgcaagcgctcttgctggttctttcgccagagcgctgagtgctagtgctgagagtcagagctttgcccaaagccaagcttttcaacaagcttcggccttccaacaagccgcaagtcaatcggctggtcaatctgcttcacgtgctggttcaacatcgagttcaaccaccactacgaccagcgcagcagcctcgcaggctgcatcccaatctgctagctcatcatcttcttctgcatttgctcaagccgcttcgagttctctggctacttcctcagcaatctctagagctttcgcgtccgtgtcatctgcgtctgcagcatcgagtttggcttataccatcggacttagtgctgctcgatctttaggtacgtcttc

SEQ ID NO: 738 - DNA, 536 bp, Artificial Sequence
  Description of Artificial Sequence: Synthetic polynucleotide
gaagacttagcaggtattgcttccgataccgcattagcaggagccttggcacaggctgttgctggtgttggtgcaggtgcatctgcgtctacatatgcgaatgtcattgcacgtgctgctggtcaatttcttgctactcaaggtgtcttggatgcaggtaatgcttccgcattggccggatcgttcgccagagctctttctgcttcggctgaatcacaatctttcgcccaatcacaagcctttcagcaggctagcgcttttcaacaggccgcttctcaaagtgcaggacagtcagcttcccgtgctggttccaccagttcttcgacaacaactacaaccagcgccgctgccagtcaagctgcatcacaatcagctagttcatcaagcagtagtgctttcgcacaagcagcaagttcctccttggcaacttcttctgccatttcaagagcttttgcttcagttagtagcgcttctgcggcatcgtcgcttgcatatacgattggcctgtccgccgctagaagtctaggtacgtcttc

SEQ ID NO: 739 - DNA, 536 bp, Artificial Sequence
  Description of Artificial Sequence: Synthetic polynucleotide
gaagacttagcaggtatagcctccgatacggcactagctggcgcacttgcccaggcagttgctggagtaggtgctggtgcttcggctagtacttacgctaacgttatagctcgtgcagctggtcagtttttggcaacccaaggagtgctggatgcaggcaatgcaagtgcattggctggtagcttcgcccgagctcttctggcttctgcggaaagtcaatcatttgcacagtcacaagcttttcaacaagcttctgccttccaacaggctgcaagtcagtcagccggacaatctgctagtagaagtggatcgagatcgagttcaactactactacaacttctgctgctgcatcccaagcagagtcacagtctgcctcatcatcctcctctagcgcttttgctcaggccgcctcctcaagcctggccacttcaagtgcaatttcacgtgctttcgcttcagtttcttctgcttccgccgcttcctctcttgcctataccattggattgtctgcagcacgtagtctaggtacgtcttc

SEQ ID NO: 740 - DNA, 536 bp, Artificial Sequence
  Description of Artificial Sequence: Synthetic polynucleotide
gaagacttagcaggtatcgcttctgacacagcattagctggagcattggctcaagccgtcgcaggtgttggtgcaggagcctctgcctcaacatacgcaaatgtcatagcgagagcagctggccagttcttggctacacagggtgtcctagacgctggtaatgctagtgctttggctggatctttcgccagagccttgtcagcatctgctgagtcgcaatcttttgcccaaagtcaagctttccaacaggctagtgccttccagcaagcagccagccaatcagctggacaatcagcgtccagagccggttccacgtctagttccactaccacaactacctctgctgccgcaagtcaagcagcaagtcaatccgcttcttcgagtagttcctctgcttttgcacaagctgctagctcctctttggccaccagttctgctatctcgcgtgcctttgccagcgttagctcagcttccgcagcttcttcattggcttatactattggtttatctgctgccagaagtttaggtacgtcttc

SEQ ID NO: 741 - DNA, 536 bp, Artificial Sequence
  Description of Artificial Sequence: Synthetic polynucleotide
gaagacttagcaggtattgcttcagatacggctttagctggcgccctagcccaagctgtggccggtgtaggtgctggagcatcggctagtacttacgcaaatgtgattgccagggctgccggtcaatttcttgctactcaaggtgtactggatgctggtaatgcctccgccttggcaggatctttcgctagagctttgagcgcatcggcagaatcacagtcttttgctcaatcccaagcattccaacaagccagtgcgttccagcaggcagcttcccaaagcgcaggacagtctgcttcgagagctggaagtacatcttcatccaccactacgacaacctctgccgctgcctctcaggcagcgagccaatcggcctccagttcttcatcttccgcatttgctcaggctgctagtagctcccttgcaacttcctctgctatatcgagggccttcgcttcagtgtcaagtgcttctgctgcaagttcgcttgcttataccattggattgtcggcagccagatcactaggtacgtcttc

SEQ ID NO: 742 - DNA, 536 bp, Artificial Sequence
  Description of Artificial Sequence: Synthetic polynucleotide
gaagacttagcaggtattgctagtgatactgctttagccggagctctggctcaagctgtggctggtgttggtgcaggagcatctgctagcacttacgctaacgttattgctagagctgccggtcagtttctggctactcagggagttttggatgcaggtaatgcgtctgccctcgcaggttccttcgccagagccctgagtgcctctgccgagtcccagtcatttgctcagagtcaagcttttcagcaagcttcggcctttcaacaagccgcatctcaatcggcaggacagtcagcatctagagcaggtagtacctcaagctcaaccactactaccacctcggttgctgcttcgcaagctgcttcacaatccgccagctcatcttctagttcagccttcgcacaagctgcctcatcctcattggccaccagtagcgccatatcaagagctttcgcaagtgtttcatcagcgtctgctgcatcatccctggcctataccattggattgagtgccgcaaggtccttaggtacgtcttc

SEQ ID NO: 743 - DNA, 536 bp, Artificial Sequence
  Description of Artificial Sequence: Synthetic polynucleotide
gaagacttagcaggtattgcttccgatactgctctggctggagctcttgcacaggctgtggcgggtgttggagctggtgcatctgcctcaacttacgcaaacgtgattgcaagagctgccggtcaatttttggcaactcaaggagtgttggacgctggtaatgcatcagccttagccggatcttttgcaagggctctatctgccagtgctgaatcgcaatcctttgcccaatcacaagcctttcagcaggcttccgcttttcaacaagcagcttcccaaagcgctggacaatcagctagtagggctggaagtaccagctcctcaactactactaccacatccgccgccgcttcgcaggctgcaagtcaatcagcctcctcatctagctcatccgcatttgcacaagctgcttcatcatctcttgcaacttcatctgctatctctagagcttttgctagcgtatcaagtgcaagcgctgcatcttccctagcctatactattggattatctgccgctagatctttaggtacgtcttc

SEQ ID NO: 744 - DNA, 536 bp, Artificial Sequence
  Description of Artificial Sequence: Synthetic polynucleotide
gaagacttagcaggtattgcctcagatactgcattggctggtgctttagctcaggccgttgcaggtgttggagccggtgcctcagctagtacctatgccaacgttattgctagggccgcaggacaatttttggcaactcaaggagttttggatgccggcaacgcttccgcacttgcaggttccttcgcaagagctttgtcagcttcagctgaatcacaatcttttgctcaatcgcaggcgtttcaacaagctagcgctttccaacaagctgcatcacagtcagccggtcagtcagcgagtagagcaggttcaacctccagttctactacgactactactagcgccgctgcttctcaggccgcatctcagtccgcttcctctagttcttcctcagcatttgcccaggctgctagcagctccctagcaacaagttccgcaatatctcgtgcatttgcttccgtttcttcagcatcagcagcctcctcactggcctacacaataggactatctgctgccaggagtctaggtacgtcttc

SEQ ID NO: 745 - DNA, 536 bp, Artificial Sequence
  Description of Artificial Sequence: Synthetic polynucleotide
gaagacttagcaggtgacaccgctgcttcctatggtaatgctttgagcacggcagctggacaattttttgccacggctggattgttaaatgccggaaatgcgtccgcattggcttcaagcttcgccagggctttttctgctagcgctgaaagtcaatcatttgctcagtcccaggctttccagcaagcatcagcatttcaacaagcagcttctagatctgcttcccaatccgcagctgaagctgactcaacgtcatcttcgacaaccacgactaccagcgctgcccggtcccaagctgctagtcaatcggcatctagttcttattcatcggcattcgctcaggcggccagttcaagtttcgcaatcagctctgccttgtcgagagcattttcttccgtttcaagcgcatctgcagcatcttctctagcatatagcatcggcttaagtgccgctaggagcttaggaattgctgacgccaccggccttgctggtgcccttgctcgtgctgtcggtgcgcttggacaaggtacgtcttc

SEQ ID NO: 746 - DNA, 536 bp, Artificial Sequence
  Description of Artificial Sequence: Synthetic polynucleotide
gaagacttagcaggtgcgactgctgcttcctatggtaacgcactgtccacagccgcagctcagttcttcgcgacagcgggtctactcaacgcaggaaacgcatccgcgttagcttcatcctttgcaagagcgttctctgcttccgccgagtctcaatcattcgcacaatcacaagctttccaacaggcaagcgcttttcaacaggccgcatctcgttctgcctctcaaagtgcagccgaggctggttccaccagttccagtaccactactaccacctctgctgcaaggagtcaagctgcctcacaatctgcatcatcttcatatagttccgccttcgctcaagcagcatcgagttcattagctacatcatcagctctatctcgtgcctttagctctgtttcgtccgcttctgcagcttcaagcttagcttattccataggactatctgccgccagaagtttgggcattgcagatgctgccggattggctggtgttttagccagggcagctggagctttgggtcaaggtacgtcttc

SEQ ID NO: 747 - DNA, 545 bp, Artificial Sequence
  Description of Artificial Sequence: Synthetic polynucleotide
gaagacttagcaggtcaatttttggccaaccagggtatactaaacactggaaatgcttcatcgttggcgagttctttcagttctgcgctttccgcatctgctgcagccgcccaaagtcaaagtttcgcgcaatcgcaagctgcggctagcgcatttcagcaggcggcctcccaaagcgctagtcaatcagctgcccaatcgggttcgcaatcatcgtctaccactacaactactagtgcatcaggaagtcagtccgcttcacaaagtgcctcttctagttctgccagcgcctcagccttcgctcagcagagctctgccagtctagctgctagctcttcgttctctcaggctttcgcgtctgctgcatccgcttccgcagttggaaacgtcgcctaccaattgggattgtctgcagcacaatctctcggtattgctaatgctggagctctagcatcagcattagcacaaagcgttagttctgtgggtgtgggtgcatctagttcagcttacgctaacgcagtcgctggagctgtaggtacgtcttc

SEQ ID NO: 748 - DNA, 857 bp, Artificial Sequence
  Description of Artificial Sequence: Synthetic polynucleotide
gaagacttagcaggttctcaggcgggttcgcaggcaggatcccaagctggatcgcaggccggatcacaggcggcatcacaagcaggatctcagtcagcctctcaggctagtgctagctcatctgctagcgcatttgcttcggccagtgcgtttgctcagagtgcttctttcgctttatcttcttctagttcttttgcctccgctgtgagctcagccagttcagtctcagcgttgggtaccttaggctatcaagttggactgcaagctgcgggaagcttaggaatctctaatagccaagcatttgcgtcatctatctctcaagctcttacgtctgttggagttggtgcctcctcatccgcttatgcatctgcagtatctggagtggttgctcagtatttgtctggaactggagtattaacatctgcaaacgcacaagctttggctagttctttcgctaatgtatttgctgcatctgccgcctccgcctctgctgcagcctctgcctcttctgctgcttccgcgcagagtgccgcagccgctctcgctcaatcgcagtccgcagcatctgcattctcacaagcggctagtcaggctttttcgcaagctgcatcccaggctggtagtcaagctgcctcacaagctggttctcaagcagctagccaagctggatcccaggccgcctctcaagcaggttctcaggccgcttcacaagctggcagccaagcagccagtcaatctggatctggtgcctcttcgttcactacaacaataagccgttctagtgctggatcgcagacgggttcccaagccggatcccaggcaggcagccaagccggatcacaagcaggtacgtcttc

SEQ ID NO: 749 - DNA, 929 bp, Artificial Sequence
  Description of Artificial Sequence: Synthetic polynucleotide
gaagacttagcaggttcacaggcgggttctcaagccggttctcaggcaggttcccaagctggatcacaggcaggatctcaggcaggatcacaagcaggtagtcaagccggctctcaagctgcttctcaggctggatctcagtccgcgtcacaagcctccgcctcttcttctgcatcagcttttgcgtctgccagcgctttcgcacaatctgcttccttcgcactttcttccagtagttcttttgcttctgctgtcagctcggcatcttccatcagcgccttaggaacgttgggatatcaagtcggactgcaagccgccggatctttgggaatttctaactcacaagccttcgcatcttcaatctcacaagcattgacttccgttggtgtcggtgcttcttcttctgcttatgcaagtgctgtatcgggtgttgttgctcagtacctttcaggaacaggtgtgctgacttccgcaaatgcacaggcattggcaagttccttcgctaacgtgttcgcagcttctgcagcgtctgctagtgctgcagcctctgcatcatcagctgctagtgcccaaagtactgctgccgccttagctcaatcgcaatctgcagcatctgctttttcccaagctgcttcccaagcatttagtcaagctgcttcacaggccggttcgcaagctgcttctcaagcaggatcacaggctgcgtcccaagctggttctcaggctgcttcacaagctggatcgcaagctgcttcgcaggctggttcacaggccgcctcacaggctggatcgcaagcagcttctcaatccggatcaggagctagctcatttactaccaccattagcagatccagtgctggatcgcaagcgggatctcaagcaggcagccaagcaggatctcaggccggatctcaagcaggtacgtcttc

SEQ ID NO: 750 - DNA, 857 bp, Artificial Sequence
  Description of Artificial Sequence: Synthetic polynucleotide
gaagacttagcaggttctcaagctggaagtcaagctggatcgcaagcaggtagtcaggcaggttctcaggctgctagtcaggccggctctcaatccgcatctcaagcttcagcttcttctagcgcttctgcatttgcttctgcttcggcatttgctcaatctgcctctttcgctcttagttcgtcctcatcatttgctagcgcagtttcaagcgcttcatcggtttcagcattgggcaccttgggataccaagtaggactgcaggcggcaggatcactaggaatttctaattcacaggcttttgcgtcaagtatttcgcaggccttaactagcgttggagttggcgcatctagttctgcgtatgcctctgccgtgtccggagtggtcgcccagtacctgtctggcactggtgtgttaacttctgctaatgcgcaagcacttgcatcatcatttgctaatgtttttgcagctagtgctgcgagcgcttccgcagctgcctcagcttcttcagccgccagcgctcaatcagccgctgccgccttggcccaatcgcagtccgcagcctcagcatttagccaggcagcctcacaggccttctcacaagcggcttctcaggctggctctcaagccgcctcacaagctggtagtcaagccgcatcacaggcaggatcccaagctgcatctcaggctggatctcaagctgcctcccaagcaggtagccaggctgcttcgcaatctggtagtggagcttcctcatttacgactactatttctcgttcatctgctggtagtcagacgggtagtcaagctggttcacaagccggttcacaggctggatcacaagcaggtacgtcttc

SEQ ID NO: 751 - DNA, 929 bp, Artificial Sequence
  Description of Artificial Sequence: Synthetic polynucleotide
gaagacttagcaggtagtcaggcaggatctcaagccggatcccaagcgggaagtcaagctggttctcaagctggatcgcaggctggaagtcaggccggatcccaggcaggaagtcaagctgcttctcaagccggaagtcagtcagcctctcaagcctcggcatcttcgtcagcttctgcgtttgcctccgcttctgcattcgctcaaagtgcctcgttcgctttaagttcgtcaagtagtttcgcatcagccgtttcttcagcctcttcgattagtgccctgggaactttgggttatcaggtgggcttacaggctgccggttctttgggcatctcaaatagtcaagctttcgcttcttcgatttctcaggcattgacttctgtcggtgttggtgccagcagttctgcttacgcgtctgctgtatctggagttgttgcccaatatctatctggaacaggtgtgttgacatcggccaatgcacaagctcttgcttcttcttttgccaacgtttttgcagcttcggctgcatcggcatctgccgctgcttctgctagtagtgcaacaagcgctcagtccgctgcagctgcacttgcacaatcgcaagctgccgcttctgcattttcacaagctgcttcccaagcaagttcccaggcttcgagccaggcttcttcccaggcagcttcccaggcctcttcacaagctagctctcaggccggaagccaggctagctcacaggccgcatcccaagctgcaagtcaggctgctagtcaagcagctagtcaagctgcctcccaatctgccgcttcagcacgtgctggagctagcagcgcgtctttcagcgcttcgcagtcaaatgctgcctctcaggctggctctcaagctgcctcacgtgctggctcacaagccgcctcacaggcaggtacgtcttc

SEQ ID NO: 752 - DNA, 452 bp, Artificial Sequence
  Description of Artificial Sequence: Synthetic polynucleotide
gaagacttagcaggtggtgctggatctgcaggtggttacggtgagggcgcaggtgcaggtgtcagatcaggcgctggagcctccgccggagctgccggtggttatggaagagctacaggtgcaggtgcaggaggagcagccgcagccggcgcttcaggatatggaggtagctacggagcaggtgccggagctggtgccgcaggtgcgggtggagcatctgcttatggagctggtattggaggtggttatggagcaggcgccgctgatgcctatggtggtggtgcttccgctggagccggtgccggtgcaggagcaggcgtttcaggtggatatggaagagcagctggtgctggagccgctgctgcagctggtgcaaacggctacggtggtagctatgatgctggagtgggcgcaggtacagcaggtgccggtgctggtgcaggtacgtcttc

SEQ ID NO: 753 - DNA, 479 bp, Artificial Sequence
  Description of Artificial Sequence: Synthetic polynucleotide
gaagacttagcaggtgcctcaggaggctacggaggaggtgcaggtgagggagctggagctgccgctgcagcaggagctggtgcaggaggtgccggtggatacggtggaggtgctggatccggagccggagcagttgccagagctggcgcaggaggtgcaggaggatacggatctggtataggcggaggttacggttctggtgcaggtgccgcagcaggtgctggcgcaggtggtgctggagcatatggaggaggatatggaacaggagctggtgccggagctaggggtgcggattctgccggcgcagccgccggatatggaggaggcgttggaactggtacgggttcatcggccggatacggtaggggtgccggagctggagcaggcgcgggtgctgccgctggatccggtgcaggtgctgcaggaggttacggtggaggctacggagcaggcgctggtgctggcgcaggtacgtcttc

SEQ ID NO: 754 - DNA, 419 bp, Artificial Sequence
  Description of Artificial Sequence: Synthetic polynucleotide
gaagacttagcaggtgccggcggtgcaactggaaaccgtgctggtgacgccttcgcccaggtattcagtcagaatgttattaacagtggagtaattacatcaaccaccgttactaagaattctgcccaggctgctgcatcttctatggtatccacagcggcgaaaagtttgggtttagatgagaataccgcccggtccatggcaaacgctatgtctagctacgctgcagctatggctaagagttttagaaattccgacgaatttataagaaatatgtcataccagatgggaagaatgcttagcaacgctggtgctatcaatgagtctactgcctccgccgcagcaagttctgcatcctcaactgttactgaaacagtgcgcacctacggtccagcagccatattttcaggtacgtcttc

SEQ ID NO: 755 - DNA, 563 bp, Artificial Sequence
  Description of Artificial Sequence: Synthetic polynucleotide
gaagacttagcaggtgcaggtgccggtggagccggcggttacgctcagggatatggagccggtgccggtgctggtgcaggtgctggtaccggagctggaggagctggtggatacggtcaaggttatggcgctggttcaggagcgggagcaggtggtgcaggtggttacggagccggagcgggtgctggagcaggtgctggaggagcatcaggttatggacaaggttacggagatggagctggtgctggtgccggcgctgctgccgcagcaggagccgctgctggagctagaggagcaggtggatacggaggtggtgccggagatggagcaggagccggtgctggtgccggagctgctggtggttacggacagggatacggagctggtgagggtgcaggtgctggagctggcgccggtggcgccggaggatatggtgctggtgctggagctggaggcgctggcggttacggacaatcttacggtgacggagcagccgcagctgctggatcgggtgctggagctggtggatctggcggatacggtgctggagcaggtacgtcttc

SEQ ID NO: 756 - DNA, 569 bp, Artificial Sequence
  Description of Artificial Sequence: Synthetic polynucleotide
gaagacttagcaggtgcaggtgctggtgcaggtgcaggttcaggtgctggtgctgcaggtggctatggtggtggtgctggcgcgggagttggcgcaggtggagcaggtggatacgatcagggttatggagccggtgccggtgcaggatccggtgctggagctggcggcgctggtggttacggaggaggtgctggtgcgggagcagatgcaggtgccggtggtgcaggtggatacggaggtggagcaggcgctggagctggcgcgagagctggagctggaggcgttggaggttatggccaatcttatggcgccggcgcaggtgccggagcaggtgttggtgccggtggtgctggagccggaggtgccgatggatatggccagggttatggtgctggagcaggtacaggagctggagatgctggaggatacggaggtggtgctggtgctggagcttccgcaggcgccggaggatatggcggcggagcaggtgctggtggtgttggtgtttatggcaaaggatacggttccggttctggagccggagcagctgccgctgcaggtacgtcttc

SEQ ID NO: 757 - DNA, 419 bp, Artificial Sequence
  Description of Artificial Sequence: Synthetic polynucleotide
gaagacttagcaggtgcgggaggtgccacaggtaatcgtgccggcgacgcctttgctcaagtcttttctcaaaatgttataaactctggtgtgataacatcgaccactgttactaagaactccgcgcaggccgcggcctcttcaatggtttccaccgcggctaagagcttaggtttggatgagaacactgcacgatcaatggctaacgctatgtcgtcgtacgctgcagccatggccaaatccttcagaaacagtgacgagttcataagaaatatgtcatatcaaatgggaagaatgctcagtaacgctggagctataaacgagtccactgctagcgcagctgcttcctcagcaagctcgactgtgactgagacggtacgtacttacggcccggccgccatattctcaggtacgtcttc

SEQ ID NO: 758 - DNA, 671 bp, Artificial Sequence
  Description of Artificial Sequence: Synthetic polynucleotide
gaagacttagcaggtgccggagctggtggcgctggtggttatgcacaaggttacggagctggtgcaggagcaggtgctggtgccggaacaggtgcaggtggtgctggtggttacggtcaaggttacggagcaggatccggcgcgggtgcaggaggagctggtggatatggtgctggtgctggagccggtgctggagccggagatgcctccggatacggtcaaggatatggagatggagcaggagctggtgctggagctgctgctgcagcaggtgccgctgctggtgctagaggagccggaggctacggaggtggtgctggagctggagcgggtgccggtgccggagctgccggaggttatggacagggttacggtgcaggtgccggagaaggagcaggtgccggcgccggtgccggtgccgttgccggtgcaggagctgctgctgctgctggagcaggtgccggtgctggaggtgccgaaggttacggtgctggcgctggtgctggcggtgccggtggttacggtcagagctacggagatggagccgcagctgcagccggctctggcgctggtgcaggtggatcaggcggatacggtgctggtgcaggcgccggatctggtgctggagcagctggcggttatggtggtggagccggtgcaggtacgtcttc

SEQ ID NO: 759 - DNA, 665 bp, Artificial Sequence
  Description of Artificial Sequence: Synthetic polynucleotide
gaagacttagcaggtgtgggtgccggaggagaaggcggttacgaccaaggatatggcgctggagcaggagcaggcagcggaggtggtgctggaggtgctggtggttacggtggaggtgccggtgcaggatctggcggtggagctggtggtgccggtggttatggtggaggcgccggagctggagcaggcgctggcgccggaggcgcaggaggatacggtggtggcgccggagcgggaactggtgcacgcgccggtgcaggtggtgtcggaggatatggacaatcctatggcgccggagcctctgccgctgccggtgcaggtgtaggagcaggaggtgctggtgctggtggagcaggtggttatggacaaggatacggtgcaggtgctggtatcggagctggtgacgccggaggctacggtggtggtgccggagccggtgcctcagctggtgctggaggatatggaggtggtgctggcgcaggagctggaggagttggtggctatggtaaaggttatggagccggttctggagctggagctgcagccgccgctggcgctggagcgggatctgccggtggatatggcagaggagacggtgctggagctggaggcgcttctggctatggccagggttacggcgccggtgccgccgcaggtacgtcttc

SEQ ID NO: 760 - DNA, 722 bp, Artificial Sequence
  Description of Artificial Sequence: Synthetic polynucleotide
gaagacttagcaggtgctggaagaggttacggtggtggatatggtggtggtgctgctgctggcgctggtgcaggtgcaggagcaggtagaggatacggtggcggttatggcggtggtgctggtagtggagctggaagcggagcaggtgcaggtggtggctctggatacggcaggggtgccggcgctggtgctggcgcaggagctgctgctgcagccggagctggagctggaggtgctggaggttacggaggtggtgctggtgccggagcaggcgcttctgctgccgctggcgcaggtgcaggagccggaggcgcaggaggatatggaggaggttatggaggaggtgctggagcgggagctggcgcaggtgcggccgctgcagccggtgcaggtgctggtgctggtgcaggacgaggatatggaggtggatttggaggaggtgcgggatcgggtgcaggagcaggagcaggagctggaggtggttcaggatacggtagaggtgctggcggttacggaggtggatacggtggtggagctggtactggtgccggcgcagcagccgccactggagctggtgccggtgctggagcaggaagaggttatggcggaggctacggaggaggcgctggagcaggagctggtgcgggagcaggcgccggaggaggatctggatatggtagaggagcaggtgctggagcgtcagttgctgcaggtacgtcttc

SEQ ID NO: 761 - DNA, 452 bp, Artificial Sequence
  Description of Artificial Sequence: Synthetic polynucleotide
gaagacttagcaggtggtcaaggtgaccaaggttaccgagtccaaggcggctacggtcctgttagtaatgctgctgcctcggccgcagctgctgcaagcgctggtggtggtcaaggagcaggacagggaggatatggacccagttctggagctgcagcagcttcagcagctggcgattcgggtggaagaggtggacgacagggttacgttggcggagccggcgcaggtgccggatcgggtgctggcggacaaggaggtcaaggtcagtacggaccaggaacgaatggagctgctgctgccgcggcagcctctgctgcctcagctggaggttccggctctcaagtttctcaggatgtagatcaaggatacggaggaggtgctggtctaggaggctctggatctggttctggtgccgctgctgctgcggcagccgctgctgcaggtacgtcttc

SEQ ID NO: 762 - DNA, 470 bp, Artificial Sequence
  Description of Artificial Sequence: Synthetic polynucleotide
gaagacttagcaggtggaggttatggaagaggtcaaggtgctggagctggtgttggagctggagccggtgccgcagctggagcagccgctatcgccagagccggtggttacggtcagggagccggaggatatggtcaaggtcaaggagcaggagctgctgcgggtgccgccgctggagcaggcgctggtggctatggtcaaggtgccggtggttatggtaggggccaaggtgcaggtgcaggagcaggtgccggtgccggtgctaggggttacggtcagggtgcaggtgccggcgctgctgccggagccgctgctagcgctggtgctggaggttatggtcaaggtgctggcggttacggccaaggtcaaggtgccggagctgctgctggcgccgctgcttctgccggagctggcggatacggacaaggtgctggaggatacggtcagggtcaaggagcaggtacgtcttc

SEQ ID NO: 763 - DNA, 467 bp, Artificial Sequence
  Description of Artificial Sequence: Synthetic polynucleotide
gaagacttagcaggtgctggagcaggagccggagcaggtgctggtggttatggtcaaggatccggtgctggcgccgcagctggcgcagcagccagtgctggagctggtggctatggccagggtgcaggaggatatggccgtggtcagggtgcttcagcaggtgctggagcaggtgcaggaactggtggatatggacagggagctggtgctggtgctgcagccggagccgctgcgtcggccggagcaggaggctatggtcaaggtgccggtggttatggacaaggaacgggagctggagcaggtggttacggtcaaggaacaggtgccggcgctgccgctggagctggtgcctctgctggagcccgaggctatggtcaacgtgcaggaggttatggtcaaggtcaaggagccggtgctgcagctggagctgccgctggtgccggccgatacggacaaggtacgtcttc

SEQ ID NO: 764 - DNA, 623 bp, Artificial Sequence
  Description of Artificial Sequence: Synthetic polynucleotide
gaagacttagcaggtgctggttatggcgctggtgcgggcgctggtgcaggttacggtgctggtgcaggagccggagccggtgcgggtgcagttgctgcgggtggcgccggcgctggtgcaggaagaggttatggtgcaggagcaggagctggcgcaggtgcagctggaggtgcaggagctggtgcaggtgcaggttatggtgccggcgctggtcgtggatatggtgctggtagtggtgctggagctggcgctggcgctgcaggcggagcaggtgctggtgctggagctggatacggcgccggagctggtgcgggagctggagccgcctcaggagctggagccggtgcaggctatggtgccggagcaggacgtggatatggagcaggagccggtgctggttccggcgccggtgcaggagctggagctgcaggtggcgctggagcaggatacggagccggagctggtgctggagcaggaagtggcgccgctgcagctggtggagcgggagctggagctggctatggagctggagctggtagaggttatggagctggagcaggtgccggttctggtgctggtgctggtgccggtgaagcgggaggagctggtgcaggtacgtcttc

SEQ ID NO: 765 - DNA, 659 bp, Artificial Sequence
  Description of Artificial Sequence: Synthetic polynucleotide
gaagacttagcaggttatggagcaggagccggaaggggttacggtgctggagcaggtgccggagcaggcgcagttgccgcatcaggtgctggcgcaggcgctggttacggagcgggagcaggtgcaggagcaggagcaggttacggtgccggagcgggtcgtggatatggtgcaggagccggagcaggtgctggttcaggagctgcctcaggagctggcgccggagccggttacggtgcaggtgccggtgcgggtgctggctatggtgccggagccggaagtggttatggtaccggagccggagctggtgccggagccgcagctgctggaggtgcaggtgcaggcgcaggatatggagcaggagcaggaaggggttatggtgctggagccggagccggtgctgcatccggtgctggtgcaggtgctggagctggtgctgcttcaggagcaggtgctggaagtggttacggagcaggagcagctgcagctggtggagccggcgctggtgctggtggaggttatggtgctggtgctggccgtggttacggagctggagccggtgccggcgcaggcgcaggttctggctcaggttcggcagctggatacggtcagggttacggatcaggtagcggtgctggtgctgccgcaggtacgtcttc

SEQ ID NO: 766 - DNA, 641 bp, Artificial Sequence
  Description of Artificial Sequence: Synthetic polynucleotide
gaagacttagcaggtgctgcagccagcggagcaggagctggtggtgctggaggatatggtagaggagctggagcaggtgctggtgccggtgccggatctgctgcaggcaacgcttttgcacaatctctttcttctaacttactaagttcgggagactttgtgcagatgatttcgtccacaacttctaccgaccaagccgttagtgtggcaacctcagttgctcaaaacgtaggaaatcaattgggtctagacgcaaacgcaatgaattctctgctgggagctgtttcaggctacgtatctactttaggaaatgcgatcagtgatgcttccgcatatgctaacgctatatcgtcagctattggaaatgttctggccaactcaggatccatctctgaatctaccgcttcatctgctgccagctcagctgcttcgtctgtgactacgacacttacttcttatggtccagcagtgttttacgcaccaacttcttctgctggcggttacggtggattggttggttatggagctggtgctggagcagctgcaggcgcaggagccggtgccggcggtgctggaggttacatcggccagggtggatatggcgctggtgccggagccgcggccgcagcaggtacgtcttc

SEQ ID NO: 767 - DNA, 458 bp, Artificial Sequence
  Description of Artificial Sequence: Synthetic polynucleotide
gaagacttagcaggtggttacggagctggtgctggtgccgttgccgctgctggcgctgctggagctggaggttacggtcgaggcgcaggaggatatggtggtcaaggcggatatggagctggcgccggtgcaggcgctgcagccgccgccggtgcgggtgctggaggagcaggtggatatggacgtggagctggagctggcgcaggagcagccgctggtgcaggagctggcgccggaggagctggctatggcggacaaggtggttacggtgccggagccggtgccggagctgcagcagcagctggagcgggtgctggtggtgccggaggctatggtagaggagcaggtgctggtgctggcgctgccgcaggcgcaggagccggtggttacggtggacagggtggatatggagccggcgctggagcaggtgctgctgcagctgcagcaggtacgtcttc

SEQ ID NO: 768 - DNA, 473 bp, Artificial Sequence
  Description of Artificial Sequence: Synthetic polynucleotide
gaagacttagcaggtgctggatcaggcggagccggaggttatggtaggggtgccggtgccggtgccggcgccgccgctggtgcaggagccggtgcaggatcttatggaggacaaggtggttatggtgcgggagctggagcaggtgccgcagctgcagcgggagctggtgctggtgccggtggatacggtcgaggagctggtgccggagctggagctggagccggtgctgctgcaagagcaggagccggagctggaggtgcaggatacggcggccagggtggatatggagccggtgccggtgctggtgctgctgccgctgctggcgctggcgccggtggtgcaggaggatacggtagaggagcaggtgcaggtgctggtgctgcagcaggtgctggagccggagcaggtggttacggtggacaaagcggctacggtgcaggagcaggtgcagctgctgcagcaggtacgtcttc

SEQ ID NO: 769 - DNA, 482 bp, Artificial Sequence
  Description of Artificial Sequence: Synthetic polynucleotide
gaagacttagcaggtgctggcgccggcggagctggaggttatggacgaggcgccggagcaggtgccggagctgctgctggagcaggtgctggtgctgctgcaggtgcgggcgcaggtggttacggtggtcaaggcggctacggagctggtgccggagcaggtgctgctgcagctgctggcgccggagcaggaggcgctggaggatacggaaggggcgctggtgctggagctggtgtcgcagcaggtgcaggcgccggaggatacggtggacaaggtggatatggagccggtgcgggagcgggagcagcagctgccgcagctactggtgcaggtggtgctggtggttatggtcgtggagctggtgctggagcaggagctgcagcaggagctggagccggtactggtggcgctggatacggaggtcagggaggttacggagctggcgccggagctggagctgccgctgctgcaggtacgtcttc

SEQ ID NO: 770 - DNA, 506 bp, Artificial Sequence
  Description of Artificial Sequence: Synthetic polynucleotide
gaagacttagcaggtgcaggagccggaggagctggttatggaagaggtgctggagcgggagctggagcagcagcaggagctggtgcaggagctgctgccggagccggtgccggagccggtggttacggaggtcaaggtggttatggcgcaggagccggagccggcgctgcggctgctgccggtgccggtgctggtggcgccgctggctattccagaggtggaagagctggagcagccggtgcaggtgctggagcagcagctggtgctggagccggagctggtggttacggtggacaaggcggttacggtgctggtgcaggagcaggtgctgcggctgcggcaggtgcaggatcaggtggtgccggcggatatggtaggggcgccggtgcaggagcggccgctggtgctggtgcagcagccggcgctggagccggtgctggaggatatggaggtcagggaggttacggtgctggagcaggagccgctgcagcagcaggtacgtcttc

SEQ ID NO: 771 - DNA, 560 bp, Artificial Sequence
  Description of Artificial Sequence: Synthetic polynucleotide
gaagacttagcaggttatggagcaggtgctggtgcaggtgctggaaccggtggtgccggaggatatggacgcggtgtcggagccggagccggagctggagctggtgccggtggagctggaggatatggtggtggacaaaactacggtgcgggagctggtgctgccgccgcagcaggagcaggcgctggtgcaggtggcgcaggtggctacggaaggggcgccggagcaggagctggcgccgctgctggtgctggtgctggagctgctgctggagctggtgctggtggtgccggaggttacggtacaggccaaggatatggagaaggagcgggcgctggtgccggtgtaggagcaggcggtgcaggtggttacggcagaggtgcaggtgccggtgctggagctggagccggcggatacggtgccggccagggttacggtgctggagcaggagcaggtgctgctgctgcagccggagcaggagccggagccggtggtgccggtggatatggacgtggagctggtgcaggagcaggtgcaggagccgctgcaggtacgtcttc

SEQ ID NO: 772 - DNA, 515 bp, Artificial Sequence
  Description of Artificial Sequence: Synthetic polynucleotide
gaagacttagcaggtgccggagcgggaggtgccggaggatacggagccggtcaaggatacggtgccggcgccggcgcaggagcagctgccggagccggtgctggaggagctagaggttacggagcgagacaaggatacggcagtggtgccggtgcaggtgctggagcaagagctggtggagccggaggatacggtagaggagccggagccggtgcagctgccgcctcaggagctggtgctggaggatacggcgctggtcaaggttatggagccggtgctggcgcagtggcctccgctgctgccggtgccggatccggagcaggaggcgctggtggctatggaagaggtgccggagctgtagccggcgctggagctggtggtgctggtggttacggcgctggcgcaggtgctgctgcaggagtaggtgcaggaggaagcggaggttacggtggacgtcaaggcggttattctgctggtgctggtgcgggtgcagcagccgctgcaggtacgtcttc

SEQ ID NO: 773 - DNA, 569 bp, Artificial Sequence
  Description of Artificial Sequence: Synthetic polynucleotide
gaagacttagcaggtggtgctggaggatatggtgtaggccaaggttatggagcaggagcgggtgccggcgctgccgcaggtgctggagctggaggcgctggtggatatggtgcaggacagggttacggagctggagccggcgtaggagctgctgctgcagctggagccggagccggtgttggcggagctggcggatatggccgaggagcgggagccggtgctggagcaggtgcaggagcagccgcaggagcaggagcaggtgctgcagccggagctggtgccggcggagcaggtggatatggagcaggacaaggttatggcgctggtgccggtgtaggagcagctgcagctgcaggagctggagctggcgtcggtggagccggtggttacggtagaggcgctggcgcgggagccggagctggagcgggaggtgctggaggttacggcagaggcgctggtgctggcgctggtgctggagccggtgccggtggagcaggtggttatggagctggccaaggttacggagctggtgctggagctggcgctgcagccgcggcaggtacgtcttc

SEQ ID NO: 774 - DNA, 623 bp, Artificial Sequence
  Description of Artificial Sequence: Synthetic polynucleotide
gaagacttagcaggtgctggagctggagcaggaggtgcaggcggatacggtagaggtgctggagccggagcgggagctggtgcaggagctggtggagctggtggttacggtgctggccaaggatacggagctggtgccggagctggagccgccgccgctgccggtgcaggagccggtgctggaggagctggaggttacggtagaggagcaggagcaggtgcaggagcaggcgctggagccggaggtgccggtggatacggtgccggacaaggctatggcgcaggtgcaggtgcaggagctgctgctgccgccggagctggtgctggagctggaggcgctggtggttatggaagaggcgctggtgcgggagccggcgctggcgcaggcgccggtggagctggaggatacggaagaggagctggtgctggtgcgggcgctggtgctgccgctggagccggagcaggtggtgctggaagatacggcgccggacaaggttacggtgctggtgctggagcaggcgctgctgccggtgcaggtgctggtggtgcaggaggttatggtgcaggtcagggttatggagctggagctggtgccggtgcagctgctgcggcaggtacgtcttc

SEQ ID NO: 775 - DNA, 581 bp, Artificial Sequence
  Description of Artificial Sequence: Synthetic polynucleotide
gaagacttagcaggtgctggtgccggtgtcggaggtgcgggtggatacggaagtggtgctggcgccggagctggtgccggtgcaggagctgcctcaggcgccgcagctggtgctgctgctggtgccggtgccggtggcgcaggcggatacggtacaggacagggttacggtgccggagcaggagccggtgcaggcgccggtgcaggcggtgctggtggatacggtcgaggcgctggtgctggtgccggagctggtgctggtggtgccggtggctatggcgccggtcaaggttacggagccggtgcaggtgctggtgccgctgctgctgctggagatggcgcaggagctggaggcgctggtggttatggtagaggagctggcgccggtgctggcgctggtgcagctgctggagctggagcaggtggtgctggtggatatggagccggacaaggttatggtgcaggtgctggagccggtgctgctgcaggagctggtgcgggaggagctggaggatatggcgctggacaaggatatggtgctggagcaggtgctggtgctgcagccgctgcaggtacgtcttc

SEQ ID NO: 776 - DNA, 569 bp, Artificial Sequence
  Description of Artificial Sequence: Synthetic polynucleotide
gaagacttagcaggtgctggtgctggtgtcggtggcgctggtggttatggtagaggcgcaggagcaggtgctggagctgctgccggagcaggagccggtgctgctgccggagctggtgcgggaggagctggtggatacggtactggtcaaggatacggcgctggcgccggagcaggtgcgggtgctggaggtgctggtggttatggaagaggtgctggagctggagctggagccggtgcgggagccggcggtgcaggtgaatatggagccggtcagggatacggagctggagcaggcgcaggagctgctgctgctgctggcgcaggagctggtgccggaggtgctggaggttacggacgaggtgctggtgcaggtgcaggtgcaggagcggctgctggagccggagctggaggtgctggcggttacggtgctcgccaaggttacggagctggtgccggcgctggtgccgctgctggagccggtgcaggtggagcaggtggctacggtgctggtcaaggttatggagctggtgctggtgctggtgcagccgcagctgcaggtacgtcttc

SEQ ID NO: 777 - DNA, 503 bp, Artificial Sequence
  Description of Artificial Sequence: Synthetic polynucleotide
gaagacttagcaggtgcaggcgcaggcgctggtggagccggtggttacggtagaggagctggtgccggagccggtgcaggagccggagctgcagcaggacagggatatggttcaggagctggagcaggagccggtgcttctgcaggaggagctggtagttacggaagaggcgcaggagctggagctgcagccgcaagtggagctggtgcaggaggttacggtgccggtcagggatacggcgccggtgccggagccgttgctagcgctgctgccggagctggatcgggtgctggaggcgctggtggatatggtagaggcgccgtagctggatctggtgccggtgctggagccggagcaggtggtgctggaggatacggagcgggagccggtgccggtgctgcagccggcgctgtagccggtggaagtggaggatacggtggtcgtcaaggaggttactccgcaggtgctggcgccggagcagcagccgccgcaggtacgtcttc

SEQ ID NO: 778 - DNA, 599 bp, Artificial Sequence
  Description of Artificial Sequence: Synthetic polynucleotide
gaagacttagcaggtgctggtgccggagccggtggagcaggaggattcggacgtggcgccggtgctggcgctggtgccggcgctggcgctgcagctggtgcaggcgccggaggagcaggcggatacggagctggtcaaggatacggcgcaggagctggtgcaggtgccgccgctgctgctggcgctggagcgggtgcgggtggtgcaggtggttacggcagaggtgccggtgccggtgctggtgccggtgctgctgcagctgctggagcgggagctggcggagcaggaggttacggagcgggccagggttatggagccggtgctggagccggagccgcagcagctgctggtgcaggagctggaactggaggagcaggtggttatggcgctggtcaaggctacggagctggagctggcgcgggagctggcgctggagcaggagcaggagcaggtggtgcaggtggatatggtagaggtgcaggagccggcgccggagccggagccggagctggtggagcaggtggatatggcgtaggtcaaggatacggtgctggagcaggtgctggtgcaggtgcaggatccgcagcaggtacgtcttc

SEQ ID NO: 779 - DNA, 407 bp, Artificial Sequence
  Description of Artificial Sequence: Synthetic polynucleotide
gaagacttagcaggtaacgcattcgcacagagtttgtcatccaacctcctttcttcaggtgactttgttcaaatgatctcgacaaccacttctaccgaccaagcagttagtgttgcaacttctgttgctcaaaacgtaggaaaccaattgggtctagatgcgaatgctatgaacaacttgttggccgcagttggtggttatgtgtcctcattgggaggtgccgttgcagacgctgctgcttacgccaatgcaattagctcagccatcggtaacgttctcgcaaatacgggctctattaatgaatcaacagcaagttccgcagcttcgagcgccgcttcatccgtcactactaccttgacttcatacggacctgcagtgttctacggaagaggtgcaggtacgtcttc

SEQ ID NO: 780 - DNA, 458 bp, Artificial Sequence
  Description of Artificial Sequence: Synthetic polynucleotide
gaagacttagcaggtgctggtgcaggtggcggctatggaggtggatatggtgcaggtggaggagcaggagctggagccggcgcgggtgctggtgccggagccggtgctggtgctggtcgtggtggagcaggaggatatggcgctggagcaggtgccggtgccggtgccgctgccgcagctgctgccggagccggagccggaggaggatatggaggaggatatggtgctggcgttggcgcgggcgctggtgcaggtgccggagctggtggtggttacggaggtggttatggagctggcgctggtgctggagctggtgctgctgctgctgcagctgcgggtgctggtgcaggcggaggttacggtggcggatacggtgcaggcggaggagcaggagcgggagccggagcaggagctggtgcaggtgcaggtgccggtgcaggtagaggaggtacgtcttc

SEQ ID NO: 781 - DNA, 464 bp, Artificial Sequence
  Description of Artificial Sequence: Synthetic polynucleotide
gaagacttagcaggtgctgtgggttatggagctggagcaggtgcaggagctgcagcagcggctgcagcgggagctggagctggaggcggttatggtggtggttatggtgctggtggtggtgctggagctggagctggtgcgggagccggtggcggatacggtggtggatatggagctggtggtggcgcaggagccggagctggagcaggcgctggtgcaggtagaggaggtgctggaggatacggtgccggtgctggagcagcagctggtgcagctgctgccgccgcagccggtgctggagctggtggaggctatggaggaggatacggagctggaggtggtgccggtgcaggtgctggagcagctgctggagcaggtgccggcgcaggtaggggaggagctggaggatatggagccggagccggtgcaggagcaggtgcagccgctgctgcaggtacgtcttc

SEQ ID NO: 782 - DNA, 419 bp, Artificial Sequence
  Description of Artificial Sequence: Synthetic polynucleotide
gaagacttagcaggttcaggtgctggcgccggttctggatacggcgctggtgctggagctggtgcaggctctggttatggagcgggttctagtgctagtgcaggctctgctattaatactcaaacagttacgagtagtactacgacttcatcacaatcatctgccgctgcaactggtgctggttacggtacaggtgctggcaccggagcctcagctggtgccgcagccagtggcgctggtgccggatacggaggacaagctggatacggtcaaggagctggagctagcgctagagctgccggatccggttacggagctggagcaggcgcggctgcagctgcaggttccggctatggtgctggtgccggtgctggagccggttcgggttatggcgctggagctgctgcaggtacgtcttc

SEQ ID NO: 783 - DNA, 545 bp, Artificial Sequence
  Description of Artificial Sequence: Synthetic polynucleotide
gaagacttagcaggtagtggatacggagcaggcgcaggtgctggtgccggcagtggttacggtgccggagccggtgctggaagcggttatggcgcaggagctggagctggtgctggctcaggctacgttgccggagcaggagcaggtgcaggtgctggttctggatatggagctggagcaggcgctggagctggttcctcatattccgctggtgcaggagccggtgctggttctggttatggcgctggtagttctgcttctgccggctcagccgtctcaacacaaactgtttccagttcagcaacgacctcgtcacagagtgccgcagctgctactggagcagcatacggtacccgagcatcaactggaagtggtgcttctgctggagctgcagcatcaggtgctggagctggttacggaggtcaggccggttatggtcaaggaggaggagctgcagcctatagagctggcgcaggatcccaggccgcttatggacaaggtgcctcgggctcatctggtgcggcagctgcagcaggtacgtcttc

SEQ ID NO: 784 - DNA, 527 bp, Artificial Sequence
  Description of Artificial Sequence: Synthetic polynucleotide
gaagacttagcaggtgcaggagctggatacggaggtcaagtcggttacggccagggtgctggcgcctcagcaggtgccgccgcagctggagccggcgccggatatggaggacaggctggttacggacaaggagccggtggatccgctggtgcagcagcagctggcgctggtgctggtagacaagcaggttacggtcagggtgcaggagcatctgctcgtgcagcagccgctggagctggcacgggatatggtcagggtgccggtgcatccgctggagccgcagcagctggtgctggtgctggttcccaggtgggatacggacaaggtgctggtgcatcctccggtgctgctgctgctgcgggtgctggtgcaggatacggcggtcaagttggttacgagcaaggcgcaggagcttcagctggagctgaagccgcagcttcatcagctggtgccggatatggtggtcaggccggttatggacaaggcgctggcgcctctgcaggtgcagcagccgcaggtacgtcttc

SEQ ID NO: 785 - DNA, 617 bp, Artificial Sequence
  Description of Artificial Sequence: Synthetic polynucleotide
gaagacttagcaggtgccggtgctggatatagaggtcaggccggttacatacagggagctggtgcctctgctggtgcagctgctgctggagctggcgtaggttatggtggacaagccggctatggtcagggcgccggcgcctctgcaggagccgcggccgcagccggtgctggtgctggcagacaagctggatatggccagggcgctggagcatcagctggagctgccgcagcgggagccggtgctggtagacaggcaggttacggtcaaggtgcaggagcctccgccggagctgctgcagcaggagctgatgctggttatggcggacaagccggttacggacaaggagcaggagcttctgcaggcgcagcagcatcaggtgcaggagctggttatggtggccaagctggctatggtcaaggcgctggtgcttctgccggtgctgcagctgctggcgctggagctggctatctaggacaggctggatacggacagggtgctggagcttctgctggcgccgctgccggagcgggtgccggatatggtggtcaggcaggttatggacaaggtactggagcagcagcttctgccgctgcctcaagtgcaggtacgtcttc

SEQ ID NO: 786 - DNA, 560 bp, Artificial Sequence
  Description of Artificial Sequence: Synthetic polynucleotide
gaagacttagcaggtggtcctggaggtccaggtggaccaggtggagcttatggtcctggagctggcggacctagcggtcctggaggagcaggtcctggaggtgttggaccttacggtccaggaggagttggtcctggaggagtcggtccgggaggtgcaggagtaggtcctggaggagctccaggtgcaccaggaggcccaggtggccctggaggtcctggaggtcctggtggagtcggaggacctctgggtgcaggtgcaggtggagtcggacctggaggagcgggagcttatggacctggaggtgccggagcatacggacctggaggagtaggacttggtggtgctggcgcttacggtcccggaggagctggaccaggaggcgcaggtccacacggtcctggcggacctggtggagcaggtccaggaggtgaaggacctgtgacagttgatgttgaagtatctgtcggtggcgctcccggaggcggatcaggaggtgttggaccaggaggagcaggagtcggaccaggtggtgctccaggtgccccaggtacgtcttc

SEQ ID NO: 787 - DNA, 827 bp, Artificial Sequence
  Description of Artificial Sequence: Synthetic polynucleotide
gaagacttagcaggtggcgcaccaggtggtggaccaggaggtgccggtccgggcggtgccggatttggacccggaggaggagccggattcggccctggaggaggtgccggtttcggcccaggaggtgctgccggaggaccaggtggtcctggtggacctggaggtccaggtggagctggtggatacggtccaggaggagctggaggatacggaccaggaggtgtcggtcctggtggagctggaggatatggacctggaggtgctggaggttacggtccaggaggttccggtccaggtggtgccggaccgggtggtgccggtggcgagggtccggttactgtagacgttgatgttactgttggacctgaaggagtgggaggaggaccaggtggcgccggtccaggaggtgcaggattcggcccaggtggcggagcgggtttcggtccaggtggcgcccctggagccccaggaggaccaggaggtcctggaggaccgggtggtccaggaggtccaggaggtgtaggaccgggtggagctggaggttacggccctggtggtgctggtggagtaggaccggctggtactggaggattcggtcctggaggagccggtggttttggacctggtggagcaggaggttttggtcctggaggagcaggtggattcggaccaggaggtgctggaggatatggtccaggtggtgttggtcctggtggtgcaggaggttttggacctggaggagttggtccaggaggatcaggacccggaggagctggtggtgaaggaccagtaacagtagatgtagacgtctcagtaggtacgtcttc

SEQ ID NO: 788 - DNA, 827 bp, Artificial Sequence
  Description of Artificial Sequence: Synthetic polynucleotide
gaagacttagcaggtggagctcctggtggtggtccaggaggagctggtcctggtggagccggatttggtccaggtggtggcgcaggttttggcccaggtggtggagctggatttggaccaggcggagctgctggcggtcctggtggtccaggtggaccaggaggtccgggaggagcaggaggttacggaccaggtggcgccggaggctacggaccaggcggcgttggtccgggtggcgctggtggatacggacccggaggagctggaggatatggtccaggaggttctggacccggcggcgccggtcctggaggagcaggtggagagggacctgtgactgtagacgtggatgtgacagttggtcctgaaggtgttggaggaggcccaggaggtgcaggccctggaggtgccggtttcggtccaggtggtggtgcaggattcggacctggcggtgcaccaggagccccaggtggcccaggtggtcctggaggtccaggaggacctggtggacctggtggtgttggacctggaggtgcgggcggttatggaccaggtggagcaggaggagtaggaccagcaggtactggtggctttggccctggtggtgccggtggtttcggcccaggaggtgctggtggtttcggacctggtggtgcaggaggatttggtccagcaggtgctggcggttacggacctggtggagttggacccggcggtgctggaggattcggaccgggaggagttggcccaggtggttcgggtcctggtggagctggaggagagggtcctgttaccgtcgatgtagacgtttctgtaggtacgtcttc

SEQ ID NO: 789 - DNA, 827 bp, Artificial Sequence
  Description of Artificial Sequence: Synthetic polynucleotide
gaagacttagcaggtggtgcccctggtggaggaccaggtggagctggcccaggaggtgctggttttggaccaggtggaggagctggatttggacctggtggtggagccggcttcggaccaggtggagcagccggtggtccgggtggtccaggaggtccaggtggaccaggaggagctggtggttatggccctggaggtgctggaggatatggtccaggcggtgtgggtccaggtggagctggtggctatggtcccggtggcgctggcggatacggaccaggtggaagcggccctggaggcgccggaccaggtggtgccggtggtgaaggaccagtcaccgtcgacgtagacgttactgttggacctgagggagtcggtggaggacccggcggtgccggtccaggaggcgccggtttcggtccaggaggaggtgccggtttcggccctggtggagccccaggagctccaggcggccctggaggtccgggaggtcctggaggaccaggaggtccgggtggcgttggaccaggtggtgcgggaggttatggtccaggtggagccggtggatttggtcctggaggcacaggcggatttggacctggaggcgctggtggttttggacctggtggcgcaggaggatttggtcctggcggtgccggaggattcggtcctggtggagctggaggatacggtccaggaggtgttggtccaggaggtgctggaggtttcggaccaggcggtgttggacctggaggaagtggtcccggcggtgccggaggtgaaggcccagttactgtggatgtcgacgtttctgtaggtacgtcttc

SEQ ID NO: 790 - DNA, 593 bp, Artificial Sequence
  Description of Artificial Sequence: Synthetic polynucleotide
gaagacttagcaggtgttagttacggacctggaggtgcaggtggtccttatggtccgggtggtccttacggaccaggtggagaaggtccaggtggagcaggaggaccttatggccctggtggtgttggaccaggaggcagtggtcctggaggttacggacctggtggagcgggcccaggaggatatggacctggcggatctggacctggcggatatggacctggtggatcaggacctggaggttatggcccaggaggaagtggtccaggcggatacggacctggtggttccggtccaggtggttacggaccaggaggatatggcccaggtggatctggtccgggcggatcgggacctggaggtagcggacctggaggatatggtcctggcggtactggtccaggtggttcaggcccgggaggttacggtcctggaggttcgggtccaggaggatctggtccaggcggttatggtccaggtggtagtggacctggaggatttggaccaggtggttccggacctggaggttacggtccaggaggatcgggtcctggaggcgcaggaccaggtggagtaggtccaggtacgtcttc

SEQ ID NO: 791 - DNA, 713 bp, Artificial Sequence
  Description of Artificial Sequence: Synthetic polynucleotide
gaagacttagcaggtggatttggaccaggtggtgctggacccggaggcgctgcaccaggtggtgccggtcctggcggtgccggtccaggtggagccggccctggaggcgccggtccaggaggcgccggtcctggtggcgcgggtccaggtggagctggaggtgcaggaggtgctggtggcagcggtggtgccggaggatctggtggtactacaataattgaagatctggatatcacaattgacggcgcggatggccctattactatttctgaagagcttcctatttctggagccggtggatctggtcctggtggcgctggtcccggaggagttggaccaggaggatctggaccaggcggagttggtccaggtggttccggtccaggcggagttggacctggtggttcgggccctggaggtgtgggtccgggcggtgctggaggcccctatggtccaggaggatccggtcctggcggagctggtggagcaggaggtccaggtggtgcttatggacctggaggatcctacggacccggaggttcaggtggtccaggaggagcaggaggcccttatggtcctggaggagagggtcctggaggcgctggtggtccttacggtccaggaggtgcaggtggtccttatggtccaggtggagcaggcggtccatacggaccaggaggagaaggcggtccatatggcccaggtacgtcttc

SEQ ID NO: 792 - DNA, 653 bp, Artificial Sequence
  Description of Artificial Sequence: Synthetic polynucleotide
gaagacttagcaggtggatcttacggacctggaggcgctggcggaccatatggacctggcggtccatatggtccaggtggagagggacctggtggtgctggtggaccatatggaccaggaggtgtcggtccaggaggaggaggtcctggcggttatggacctggtggcgcgggacctggaggctacggaccaggtggatctggtcccggcggttacggaccaggtggtagcggccctggtggatatggtcctggtggctccggtccgggtggttatggtccaggtggttctggccctggtggttatggaccaggtggttccggtccaggtggctcaggccctggaggatacggacctggtggctcaggtcctggaggaagcggacctggtggctatggcccaggaggtagtggtcccggcggatatggtcctggaggatcgggaccaggtggctcaggaccaggaggttatggtcctggaggttcgggacctggtggttctggtccaggtggttacggaccaggaggatcaggacctggaggattcggtccaggaggatttggaccaggaggctcaggaccaggtggatacggcccaggcggttctggtccaggaggcgccggcccaggtggtgttggtccaggtacgtcttc

SEQ ID NO: 793 - DNA, 722 bp, Artificial Sequence
  Description of Artificial Sequence: Synthetic polynucleotide
gaagacttagcaggtggatttggtccaggtggcgcaggccctggaggtgcaggccctggtggagcaggtcctggtggagctggccctggaggtgccggccctggaggagcaggtccaggtggcgctggacctggcggcgctggacctggtggagccggtggtgctggcggtgctggcggtgccggaggatcaggaggcgcgggaggcagcggtggaactactattatcgaagatttagacatcaccattgatggagctgatggccctatcacaatttccgaagaattgactatatccggtgcaggtggcagtggaccaggaggagctggtcctggtggagttggaccaggtggaagcggacctggtggtgttggcccaggtggtagtggtcctggaggagttggtccgggaggatccggacccggaggtgtcggtcctggtggagccggaggtccatacggaccgggtggatccggacctggcggcgccggtggagctggaggacctggtggtgcatatggaccaggtggatcctatggaccaggaggaagtggtggccccggtggagctggtggcccatacggaccaggaggcgaaggaccaggtggagcaggtggcccttacggaccaggtggtgccggaggtccttacggtcctggtggcgccggaggtccatatggtccaggcggtgaaggtggcccttatggtccaggtacgtcttc

SEQ ID NO: 794 - DNA, 563 bp, Artificial Sequence
  Description of Artificial Sequence: Synthetic polynucleotide
gaagacttagcaggtggtagctatggtccaggtggagctggaggtccttacggaccaggtggtccatacggccctggtggagaaggtccaggaggtgccggtggtccttatggacctggcggagttggcccaggtggaggcggtccaggaggttacggtccgggaggtgccggaccaggcggatacggacctggcggatcaggaccaggtggatacggccctggaggctcaggaccaggaggatacggcccaggtggatccggccctggtggttacggccctggaggatcaggacctggtggatatggtccaggtggtagtggtcctggtggttcaggacctggaggttacggtccaggtggttccggtccaggaggctatggtccaggaggatccggtcctggaggatccggaccaggcggctatggacctggaggttcaggtccaggtggattcggacctggaggttttggacctggaggatcaggtccaggaggttatggtccgggaggatcgggtcctggtggtgctggaccaggaggtgtaggaccaggtacgtcttc

SEQ ID NO: 795 - DNA, 722 bp, Artificial Sequence
  Description of Artificial Sequence: Synthetic polynucleotide
gaagacttagcaggtggttttggacctggtggagctggaccaggaggagccggacctggtggtgcaggcccaggaggagctggaccaggtggtgctggtccgggtggtgccggtccaggaggtgctggtcctggtggagcgggtccaggtggagcaggaggtgctggtggagctggaggagctggaggtagcggtggtgcaggaggttctggaggaacaaccatcatcgaagatttagatatcactatcgatggagctgacggcccaatcacaatatccgaggaacttacaatctctggagccggtggatcaggtccgggtggtgctggacctggtggtgtaggacctggtggatcaggaccgggtggtgttggacccggaggtagcggtccaggaggcgttggtcctggtggctcaggagccggtggagtgggtccaggaggtgccggaggaccttatggtcctggtggatctggaccaggtggagctggaggcgcaggaggacctggaggtgcctatggtcctggaggttcgtacggaccaggtggatcgggtggtcctggaggagcaggaggaccttacggtcctggtggtgaaggtcctggaggtgctggtggtccatacggcccaggtggagctggtggtccttacggacctggtggagccggaggtccttatggtccaggtggtgaaggaggaccatacggcccaggtacgtcttc

SEQ ID NO: 796 - DNA, 878 bp, Artificial Sequence
  Description of Artificial Sequence: Synthetic polynucleotide
gaagacttagcaggtgcaggtggttcaggaccaggtggtgctggtccaggaggcgctggcccaggtggagctggacctggtggtgccggacctggtggcgctggtcctggaggagttggaccaggcggtgccggtggacctggaggtgctggtggtccatttggtcctggaggttctggacctggcggagctggaggagcgggtggtccatacggtcccggtggagcgtatggccctggaggaccaggtggaccaggaggaccaggcggaccaggttctggtggaccatacggaccaggaggtgcctatggtccaggtggagcttacggtcctggcggtgcttacggaccaggtggtgcaggcggaccaggtggagcaggtggcccatacggtcctggaggtccttatggacctggcggaccatatggacctggtggtgcaggtggtccaggcggagctggtggtccatatggcccaggcggagcaggtccaggaggatatggccctggcggagcaggaccaggaggttacggacctggtggaagtggtccaggtggtgcgggtccaggtggatatggtcctggtggatccggtcctggaggtgccggacccggaggctatggtccaggcggtgctggacctggaggatatggcccaggaggagctggtccaggaggtgcaggtccaggtggagccggtccgggaggatatggacctggcggaagcggtccaggtggtcctggtagtggtggtcctggtggtgctggtggttctggtggtactactgtcatcgaggacctggatattactgtaaatggcccaggcggacctattaccattagcgaagaattgaccgtcggaggcccaggtacgtcttc

SEQ ID NO: 797 - DNA, 830 bp, Artificial Sequence
  Description of Artificial Sequence: Synthetic polynucleotide
gaagacttagcaggtgcaggtggctcaggccctggtggagcaggacctggaggtgccggtcctggaggcgctggacccggcggtgttggaccgggaggagctggaggacctggtggagccggcggtccatttggaccaggtggttccggaccaggtggcgctggtggcgctggtggtccatacggccctggcggagcttatggtccaggtggccctggtggtccaggtggtcctggtggcccaggctctggtggtccttacggaccaggtggagcttacggaccgggtggagcatatggtccaggaggagcatatggaccaggcggagccggaggtccatacggaccaggtggtccttacggccccggaggaccttacggtcccggtggtgcaggtggacccggaggcgccggtggtccatacggacccggtggtgctggtccgggtggatacggtccaggaggcgcaggtccaggaggttatggaccaggcggttctggacctggaggtgcaggacccggtggatatggacccggtggatccggacctggcggagccggacctggtggatatggacctggtggtgcaggtccaggcggttacggacctggtggcgctggacctggcggtgctggtcctggaggtgctggacctggcggatatggcccaggtggttctggtcctggaggacctggttcaggaggaccgggtggagccggaggatcaggcggtacaacagtcatcgaagatttagatattaccgtcaacggcccgggcggaccaatcacaatttctgaagagttgactgtaggaggtccaggtacgtcttc

SEQ ID NO: 798 - DNA, 887 bp, Artificial Sequence
  Description of Artificial Sequence: Synthetic polynucleotide
gaagacttagcaggtgcaggtggatctggtccaggaggtgccggtccgggcggagctggtccaggcggcgcaggaccaggcggtgctggtcctggcggtgctggtcccggaggagttggacccggtggagctggtggtcctggtggagctggaggtcccttcggacctggaggaagcggaccaggaggagcaggaggtgcaggaggaccttacggaccaggtggcgcctatggacctggcggtccaggaggccctggaggacctggcggaccgggtggccctggatccggtggaccatatggcccaggtggtgcgtacggccctggtggagcatatggtcctggaggagcatatggaccaggtggtgctggtggacctggcggcgcagcaggtccctacggaccaggcggaccatatggtccaggtggtccgtacggaccaggtggtgcaggcggacctggtggtgctggaggaccatacggtcctggaggtgcgggacctggcggttatggtccaggcggtgcaggtcctggcggatatggtccaggtggatcaggaccaggaggagccggacctggaggatatggacctggtggttcaggtccaggtggagccggacctggtggatacggccctggtggtgccggacctggaggctacggacctggaggagctggcccaggaggtgccggaccgggtggagctggacctggtggttacggtccaggaggttctggtccgggtggtcctggtagtggaggaccaggtggtgccggtggaagcggtggcactacagttattgaagatctagatattaccttaaatggacctggaggtcctataacgatctccgaagagctgactgtaggaggaccaggtacgtcttc

SEQ ID NO: 799 - DNA, 554 bp, Artificial Sequence
  Description of Artificial Sequence: Synthetic polynucleotide
gaagacttagcaggtgcaggtggttctggcccaggtggtgctggtccaggaggagtgggaccaggacgttcaggccctggaggtgttggaccaggaggctctggtccaggttctgttggtcctggaggatctggacaaggaggtttgggcattggtagaagtggccctggcggtgttggcccaggtggttcaggaccaggatctattggacctggaggtagcggtcagggaggtcttggtcctggtggttcaggtcagggtggtttgggcccaggaggttcaggacctggaggagttggctccggcggagttggaggaccatacggtccaggtggatctggcccaggaggagtgggtggagcaggaggaccatatggtccgggcggtagcggtggaccaggtggagctggaggaccatatggacctggtggaccttatggtcctggtggtgctggaggaccttacggccctggcggagcaggtggaccttacggaccgggtggtccatacggccctggtggtgctggcggtcctggtggaggaggtacgtcttc

SEQ ID NO: 800 - DNA, 596 bp, Artificial Sequence
  Description of Artificial Sequence: Synthetic polynucleotide
gaagacttagcaggtccaggaggtgccggtggtccatatggaccgggaggaccaggtggcgcgggtcctggtggctacggtccaggaggatatggaccaggtggtgctggtccaggtggagcaggaccgggaggctatggaccaggtggagccggtcctggaggatatggtccaggaggtgcaggtcctggcggtagcggtcctggtggcataggtccaggtggatccggaccaggaggatacggtccaggtggaattggcccgggaggaactggccccggtggtgctggacctggtggtgcaggtccaggtggtgctggcccatccggtgctggtcctggtggcgctggtccatcaggtgccggaagaggtggttccggtaggggttcggttggccgaggtggcgccggcagaggtggagccggtagaggaggtgcaggaggagcaggcggatccggaggcgcaggtggctctggcggtgccggcggatctggaggaacaacaatcatcgaggaccttgatattaccgttgatggagctaatggtccaattactattagtgaagaactaactataggtggtgcaggtacgtcttc

SEQ ID NO: 801 - DNA, 608 bp, Artificial Sequence
  Description of Artificial Sequence: Synthetic polynucleotide
gaagacttagcaggtgccggaggtgtaggtcccggaggttctggcccgggaggtgtaggacctggcggatcaggacctggtggtgtcggacctggaggatccggtccaggcggagttggctctggaggatcaggacctggaggtgttggacctggtggatccggtcctggcggtgtcggatccggaggtttcggtccaggtggtattggaccaggaggtagtggtcccggtggagttggtcctggaggagtcggaggaccatatggaccaggcggatcaggccctggtggagctggtggagcaggcggatcttacggtccaggcggaccatatggcccaggcggtagtggaggacccggtggtgccggtggaccatatggtccgggaggtgcaggaggcccttacggaccgggaggaccttatggtcctggaggagcaggtggtccaggtggcgagggaccgggtggcgcgggaggtccgtatggaccaggaggaccaggaggtgccggtcctggtggttatggtcctggtggtgctggtcctggaggatatggacctggaggagctggcccaggaggttacggacctggtggtgcaggtacgtcttc

SEQ ID NO: 802 - DNA, 671 bp, Artificial Sequence
  Description of Artificial Sequence: Synthetic polynucleotide
gaagacttagcaggttctggaggttacggaccaggtggtgcaggtccaggaggctatggacctggtggccctggacctggtggctatggtccaggtggtgcaggccctggtggttacggaccaggaggtactggacctggtggatccgccccgggcggtgcgggcccaggtggtgctggcccaggtggatacggtcctggaggttccggtccaggtggttatggaccaggtggtggaccaggaggtgccggcccaggtggagcaggtccaggaggtgctggccctggcggagcaggtcctggaggtgccggccctggaggtgccggtcctggtggagctggtccaggaggtgccggacctggtggagccggccctggtggagctggcccaggaggagtgggaacaggtggactgggaagaggcggagctggaaggggaggagctggaagaggaggtgccggtcgaggaggtgccggacgaggaggtgcaggtcgtggtggaacaggtggagttggtggagccggtggcgctggaggagctggtggtgtcggtggagctggtggatccggaggtactaccgttattgaagatttagacataactattgatggtgccgacggtccaattacaatatctgaggagttgacaatttccggtgcaggtacgtcttc

SEQ ID NO: 803 - DNA, 617 bp, Artificial Sequence
  Description of Artificial Sequence: Synthetic polynucleotide
gaagacttagcaggtgccggaggaagtggtccaggaggtgcaggtcctggaggtgtcggtccaggtggatcaggacctggaggtgttggtcctggaggttcaggccctggtggtgttggtccaggaggagcgggcggtccatataggccaggcggatctggacctggaggagcaggaggtgcaggtggtcctggcggagcatatggtccaggaggatcaggaggtcctggtggagctggtggcccgtacggccctggtggagaaggtccaggtggcagtggcggcccatacggaccgggaggagaaggaccaggtggtgctggaggcccatatggtccaggcggcgctggcggtccatacggtccaggaggagctggaggaccatatggtccaggtggagctggtggaccatatggcccaggtggtgccggtggcccttatggaccaggtggagccggtggcccatacggccctggtggtgcaggaggaccttatggacctggtggagagggtccaggtggagcaggtggtccttacggacctggaggagttggtccaggtggaaccggtccaggaggttatggtcctggcggtgccggcccaggaggtacgtcttc

SEQ ID NO: 804 - DNA, 647 bp, Artificial Sequence
  Description of Artificial Sequence: Synthetic polynucleotide
gaagacttagcaggttatggacctggaggatccggtccaggaggctacggccctggtggttctggtcctggtggttttggaccgggtggatctggaccaggtggatacggacctggtggaagtggaccaggaggatacggtccgggaggttctggacctggtggtgctggacctggtggttacggacctggaggaaccggtcctggaggatcaggacctggtggatacggtccaggaggtagcggacctggtggatatggtcctggtggtagtggaccaggtggttatggccctggaggatcgggcccgggtggtgccggtccaggtggcgctggaccaggtggagccggacctggtggagctggaccaggaggagttggtccaggtggtgcaggtcctggaggatctggacctggcggagctggtccaggaggagcaggaagaggtggagcaggccgtggaggcgcaggtcctggaggtgctggacccggtggagctggtggagcgggtggagccggaggatccggtggagcaggcggaagcggaggaactaccgttatagaggacctggatataactattgatggagctgacggacctatcacaatctcagaagagttgactattaatggcgcaggtacgtcttc

SEQ ID NO: 805 - DNA, 572 bp, Artificial Sequence
  Description of Artificial Sequence: Synthetic polynucleotide
gaagacttagcaggtgctggtggttctggaccaggaggcgccggccctggtggtgtaggccctggtggatcgggaccaggtggagtaggaccaggtggaagtggaccaggcggagtgggaccaggtggagctggaggtccttatggacctggaggctctggacctggcggagctggtggtgctggcggccctggaggagcatacggtccaggcggttcgggtggtccaggaggagctggcggaccttatggtccgggaggcgaaggaccaggtggtgctggtggaccatacggtcctggaggtgaaggtcctggaggtgctggaggtccatacggtcctggtggtgcaggaggaccatatggtcctggaggtgccggtggcccttacggccctggaggtgcaggcggtccatacggtccaggtggcgctggaggtccatatggcccaggaggtgttggaccgggaggaactggtccgggtggctacggacctggcggtgctggtccaggcggttatggtcctggaggatcaggtcctggaggttacggtccaggaggatcaggtacgtcttc

SEQ ID NO: 806 - DNA, 626 bp, Artificial Sequence
  Description of Artificial Sequence: Synthetic polynucleotide
gaagacttagcaggtcctggtggatatggacctggcggttcaggaccaggaggatttggaccaggtggttctggtcctggaggatctggtccaggtggctcgggtcctggaggatatggtcctggaggttctggtccaggtggatacggtcccggtggttctggcccaggtggttacggaccaggcggatctggtccaggaggctatggtccaggtggatccggaccaggaggaagtggccctggaggatacggtccaggtggaagcggaccaggtggttatggacctggtggatccggacctggaggagcgggacctggaggtgctggcccaggtggagtcggtccaggaggtgcaggtcctggcggagccggtcctggtggagttggtcccggtggcgctggtcctggtggtgctggaccaggtggtgcaggacctggtggagctggccgtggtggtgccggaccaggcggtgctggtggtgccggtggagctggtggatctggtggagctggtggtagtggtggaactacagtaattgaggatttggatataaccatcgacggtgctgatggaccgattactattagcgaagaacttaccatcggtggtgcaggtacgtcttc

SEQ ID NO: 807 - DNA, 647 bp, Artificial Sequence
  Description of Artificial Sequence: Synthetic polynucleotide
gaagacttagcaggtatcaatgtcgattccgacataggttctgtaacctcgctcatactgtcaggtagcactctacaaatgactataccagccggtggtgatgatcttagcggaggttaccctggaggattcccagctggagcacaaccgagtggtggcgctcctgttgatttcggcggaccatcagctggcggtgacgttgctgcaaagctggctagatctttggcatctacattggcctcatcaggtgttttcagagcagcgtttaattccagagtatcaacacctgttgctgttcagtttacagatgccctagtgcagaaaatcgcctccaatcttggactggattacgctacggctagtaagctgcgaaaggcatcccaggctgtctccaaggtcagaatgggaagtgacactaacgcctacgccctggctatttcttcagctttagctgaagtattgtcctcatccggaaaagtcgcagacgctaatattaatcagattgctcctcagctagcctcaggtatcgttttaggagtttctactacggccccacagtttggagtagacttgagctcaattaatgttaatctcgacatttccaatgttgctcgcaatatgcaagccagcatacaaggtacgtcttc

SEQ ID NO: 808 - DNA, 527 bp, Artificial Sequence
  Description of Artificial Sequence: Synthetic polynucleotide
gaagacttagcaggtggtccagccccaattaccgctgaaggcccagatttcggtgcaggatatccaggaggagctcctacagatttgagtggattggatatgggtgctccctccgatggctctcgcggaggagatgctaccgccaaactattgcaagctctagttccagcactgcttaaatccgatgtgtttagagcaatctacaagagaggcactagaaaacaagtcgtacagtatgtcactaattctgctctccaacaagccgcctcttcacttggtctggatgcatcaacaatatctcagctacagacaaaggctactcaagctttgtctagtgtgagcgctgattctgactctaccgcatacgctaaggcctttggtttggcaattgctcaagtgttgggaacctctggacaagtaaacgatgcaaatgttaaccagattggtgccaagttagccactggtattctcagaggatcttccgctgtcgcccccagactgggtattgacctgtcaggtacgtcttc

SEQ ID NO: 809 - DNA, 647 bp, Artificial Sequence
  Description of Artificial Sequence: Synthetic polynucleotide
gaagacttagcaggtatcaacgtcgattcagatataggatccgtaacatctcttatcttaagtggttctactttgcaaatgaccattccggcaggaggagatgacctgagcggtggatatcctggtggatttccagcaggagctcagccatctggtggtgctccagtagattttggaggaccatcggcgggtggtgacgtcgctgcaaaacttgcccgttctctcgcttcgaccctggcctccagtggagtatttcgtgctgctttcaacagcagagtttcaactccagttgcagtgcaactgaccgatgcgttggtccaaaagatcgcctcaaatcttggcttggattacgctactgcatcgaagctccgtaaggcatctcaggctgtttctaaggtccgcatgggatcagatactaacgcatacgctttggctatctcatcagcattggcagaggttttgagttcctcaggtaaagtcgctgacgccaacattaatcagatcgctccgcaacttgcttctggaatcgtcttaggcgtttcgaccacagcacctcaatttggagttgatttaagttctataaacgtgaacttggatatttccaatgtcgctaggaacatgcaagccagcatacaaggtacgtcttc

SEQ ID NO: 810 - DNA, 527 bp, Artificial Sequence
  Description of Artificial Sequence: Synthetic polynucleotide
gaagacttagcaggtggacctgctccaatcaccgctgagggtccagactttggagctggatacccaggtggcgcccctactgaccttagtggattggacatgggtgccccttcagatggatcgcgcggtggtgatgcaaccgctaaattgcttcaagctttagtgcccgcacttctaaaatccgatgtattcagagcaatatataagagaggaacgagaaaacaagtagttcaatacgttacgaactcggcgttacaacaagctgctagttctttaggtttggatgcctccacgatttcccagttgcaaactaaggccacccaagccttatcttcggttagcgctgactccgattctactgcctatgccaaagcttttggactggccattgctcaggtactaggaacttcaggtcaggttaatgacgctaacgtgaatcaaatcggagcaaaactcgcaactggtattttgcgtggatcatctgctgttgctcctagattgggaatcgacctatcaggtacgtcttc

SEQ ID NO: 811 - DNA, 647 bp, Artificial Sequence
  Description of Artificial Sequence: Synthetic polynucleotide
gaagacttagcaggtatcaacgttgattccgatattggaagtgtgactagtctgattttgtccggctccacattgcaaatgaccattccagccggtggtgacgacctgagcggaggttacccaggcggattgcctagcggcgctcaaccaagtggtggtgctcctgtggattttggtggaccatctgcaggtggagatgtcgcggcgaaactggcgagatcattggctagcactttggcctctagtggtgtttttagggcagctttcaactcccgtgttagcacacctgttgctgtccaactaacagatgcactggtgcagaagatcgcaagtaatttaggacttgattacgccaccgcctcaaaattgagaaaagcatctcaggctgtatctaaggtgcgcatgggttctgacacaaatgcatacgcactggctatttcttcagccttggctgaagtgctatcaagttccggaaaggtcgcagacgccaatattaaccaaattgcaccgcagctagcatctggaatcgttttgggtgtcagtaccactgcaccccaatttggtgttgacctatcttcaattaatgttaacctggacatctctaacgtggctcgcaatatgcaggcatccattcaaggtacgtcttc

SEQ ID NO: 812 - DNA, 527 bp, Artificial Sequence
  Description of Artificial Sequence: Synthetic polynucleotide
gaagacttagcaggtggtccagcacctattaccgctgagggtcctgactttggtgcaggatatcccggtggcgcacctactgacttaagcggactcgatatgggagctccatctgatggatccagaggaggtgacgccacagccaagctattacaggccctcgtaccagcgcttctaaagtctgatgtttttagagccatatacaagagaggaactcgtaagcaagttgtgcagtacgtaactaactcggctcttcaacaagcagcgtcgtcgctaggtctagacgccagtaccatttctcagttgcagactaaagccacgcaagctttgtcatcagtatcagctgattcagactctaccgcttatgctaaggcttttggactggcaatcgctcaagttttgggtacctcaggccaagtgaacgacgctaacgttaatcagataggtgctaaattggcaactggcatattaagaggtagcagcgctgtcgcgcctaggctgggcattgacttgtcaggtacgtcttc

SEQ ID NO: 813 - DNA, 647 bp, Artificial Sequence
  Description of Artificial Sequence: Synthetic polynucleotide
gaagacttagcaggtatcaacgtcgacagtgatattggaagtgtaacgagcttgatcttgagcggtagtaccttacaaatgactatccctgccggtggtgacgacctcagcggtggctacccaggaggattcccagctggagctcagccttcaggaggtgctccagtcgattttggaggaccatctgctggaggtgacgtcgctgctaaattggccagatctctggcctcaactctggcatcgtctggagtatttagagcagcatttaattccagagtatccacacctgttgctgtacaactgacagatgctctcgtccaaaagattgctagcaatcttggactagactatgctactgcctcaaagttgagaaaggcgagtcaagctgtcagcaaagttagaatgggttctgatactaatgcctatgcactagcgatcagctccgcattagccgaggttttgtcatcttcgggtaaggtcgccgatgcaaacattaaccaaatcgctccacaattagcttctggaattgtgctaggagtcagtaccacagctcctcaattcggcgtggatttatcatctattaatgttaaccttgatatatcgaatgtcgcgaggaacatgcaagccagcattcaaggtacgtcttc

SEQ ID NO: 814 - DNA, 527 bp, Artificial Sequence
  Description of Artificial Sequence: Synthetic polynucleotide
gaagacttagcaggtggtccagcaccgattacagctgaaggacctgatttcggtgctggatacccaggaggagctccaaccgatctaagcggcctcgacatgggagccccatctgacggttctagaggtggagacgctacagccaaactattgcaggctctcgttcctgccttactaaagtctgacgtttttagagcgatatataagagaggtacacggaagcaagtggtgcaatacgttaccaactccgctttgcagcaggctgcttcttcgttgggtttagacgcatccactatttcacaattgcagacgaaggcaacacaggccctttcctctgtcagtgccgattcggatagcaccgcctacgcaaaggctttcggtttggctattgctcaggtgctaggtacttctggacaagtcaacgacgctaatgtgaatcagattggagctaaattggctaccggtattcttagaggatcttctgccgtagcccctagattgggcatagacctttcaggtacgtcttc

SEQ ID NO: 815 - DNA, 647 bp, Artificial Sequence
  Description of Artificial Sequence: Synthetic polynucleotide
gaagacttagcaggtattaacgtcgattcagacatcggttctgtgacaagtttaatattgtctggttccactttgcaaatgaccataccagctggcggtgacgatctgagtggcggctaccctggcggattcccatctggtgctcaaccttccggaggagctcctgttgattttggaggtccatctgctggtggtgatgttgcagctaaattagcacgatctctagcatctacgttggcatcgtccggcgtatttagggcggcttttaactctagagtgtcaacacctgttgctgtacaattaaccgatgctctcgtgcagaagatcgccagtaacctgggtttggactatgcaactgcttcgaaactaagaaaggcttctcaagcggttagcaaggtccgcatgggctccgacaccaacgcctatgcattggcgatatcaagtgcactcgctgaggttttgttgagctctggaaaggtagcagacgccaacattaaccagatcgctcctcaactcgcctcaggcatagttttaggtgtttctactgcagcaccacagtttggcgttgacttatcaagcattaatgtgaacctggatatctctaacgtggccagaaacatgcaagcaagcatacaaggtacgtcttc

SEQ ID NO: 816 - DNA, 527 bp, Artificial Sequence
  Description of Artificial Sequence: Synthetic polynucleotide
gaagacttagcaggtggacctgccccaataacggctgaaggacctgattttggtgctggttaccctggcggtgcacctactgatctgtcaggactggacatgggtgccccatccgacggcagtaggggaggcgacgctacagctaaactattgcaggctctggtgccggcgctgttgaagagtgacgtttttagagctatttataaaagaggtacacgaaaacaagtcgtgcagtatgtcactaattctgctttacaacaggccgcatcttccttgggcctggacgcttctactatatcccagttgcaaacaaaagcaacccaagcattgtcctccgtttctgctgattccgactctacagcatatgctaaagcatttggtttggcaattgcccaagttctgggtactagcggtcaggtaaatgatgctaacgtaaatcagatcggagcaaaacttgccaccggtatattgagaggttcctcagctgttgcccctagactaggaattgatttgtcaggtacgtcttc

SEQ ID NO: 817 - DNA, 668 bp, Artificial Sequence
  Description of Artificial Sequence: Synthetic polynucleotide
gaagacttagcaggttcttccgccggacttgtaagcagagtcgcaaatgcattggctaacaccagtacattacgcgctgttctgcgaaggggtgtaagtcaacagactgcttcctccgtcgtgcagagagccgttcaatcccttgccggaacgctaggagttgatggaaattccttgtccagaattgccctgcaagcaattagtcaattgcctggtggtagtgatacttctgcatacgcccaggctttctcatctgctttattcaacgcaggtgtattgaacgcttcaaacatagacactttgggttcgagggttttgtctgccgttctgaacggtgtctcttctgccgcccaaggtattggactcaacgttgatacaggttctgtacaaagcgacatttcttctagttcatcttttttatcaagtagtagttcgtcggcaagtttcagccaaacctccgcttcgagcacctctggtgccggttatacagccccagctggaccgtctggatacactggtccttccggaccatccggatacacgggtccggtaggaggtgctgctcaatttggatctgtttcaggtcaaacatctttcggacaaacatcaggatttactgcaagtaccggcggacaggctgctttcggtgcaacctcaggtacgtcttc

SEQ ID NO: 818 - DNA, 668 bp, Artificial Sequence
  Description of Artificial Sequence: Synthetic polynucleotide
gaagacttagcaggttctagtgccggattggtcagtagagtcgctaatgcattagctaatacaagtacattgagagcggtcttgcgaagaggcgtatctcaacagacagcctcctccgtggtccagagagctgtccaatctcttgcaggcacgttgggagttgacggaaacagtctttcaagaattgctttgcaagctattagtcaattgccagctggtagtgacacttcagcatatgctcaagcgttcagttccgcattagttaatgctggtgttttgaacgcctctaacattgacacattgggttcacgcgtcctaagtgcagtgcttaacggcgtttcatccgctgcgcaaggaataggattaaacgtcgataccggcagtgtccagtctgatatctcaagttctagctcttttttgtccagttcgtcgtccagtgcttctttttcacagaccagcgccagtagcactagcggcgctggttatactggacctagtggaccttcaggatatacaggtccagccggtccatccggatataccggtcctgttggcggtgctgctcagttcggttcggtaagtggacagacttctttcggacaaacctctggttttacagcttctacgggaggacaggccgccttcggtgctacttcaggtacgtcttc

SEQ ID NO: 819 - DNA, 668 bp, Artificial Sequence
  Description of Artificial Sequence: Synthetic polynucleotide
gaagacttagcaggttcttcagctggattggtgtctagagttgccaacgcattggcaaacacatctacactcagggctgtcctgagacgtggagtgtccccacaaacagcctcatccgttgttcaacgtgcagttcagtctttggcaggtacactgggtgtcgatggaaattcgctctctagaattgccctccaagccatctcccaactgccagctggttctgacacgtctgcatacgcccaggccttttccagtgctttggtaaatgccggagtgctctccgcctctaatattgataccttgggttcaagagttttaagtgctgtcttgaacggagtctcctcagctgcccaaggtataggcttgaacgtcgatacaggatccgttcaatctgacatcagttctagtagctcatttctatcatcttcatctagctcttcctcaatttcccaaacttctgcatcttcgacatcaggtgcgggttataccggtcccgcaggtccaagtggatacacaggaccatcgggtccgtcaggatatacgggacctgtgggaggtgcggcacagtttggctcagtatctggtcaaacgagcttcggtcagacaagcggattcaccgcctcaaccggtggacaggctgcctttggtgcgacctcaggtacgtcttc

SEQ ID NO: 820 - DNA, 668 bp, Artificial Sequence
  Description of Artificial Sequence: Synthetic polynucleotide
gaagacttagcaggttcttctgcaggacttgtttcccgagttgctaatgccctggctaacacatccactttaagggctgtgctgagaagaggagtctcgcaacaaacagcctcaagcgtcgtccaaagagccgttcagtccttggccggaactctgggtgttgatggtaactctcttagccgtatcgctttacaagctatctctcaattgccagcaggatccgatacctccgcttacgcccaggccttctcttcggctctggttaacgccggcgttttgaatgctagtaacattgatacgttgggtagcagagttttgagcgctgtactgaacggtgtaagcagtgccgcccagggaattggactcaacgtcgactcaggctcgattcagagcgacatttcatcatcctctagctttttgtcatcatcgagttcctcgtcctcaatttcccaaacatctgcatcaagtacatccggtgcaggatatactggacctgctggtccgtcaggctacacaggcccatctggtccatcaggttacacaggacccgtaggtggagccgctcagtttggatcggtgtcaggtcagacatcttttggtcaaacttctggatttaccgctagtactggcggacaagcggcctttggagctacgtcaggtacgtcttc

SEQ ID NO: 821 - DNA, 632 bp, Artificial Sequence
  Description of Artificial Sequence: Synthetic polynucleotide
gaagacttagcaggtggaggtgtcggaagcctcaccggtcagacttcttttggccagactagcggcttcacgagtactgcgggagcacaaggcggtttcggcccaacaaccggcgcccaaagtgcattgatttctaggattgcaaacgccttggcaaatacttcaacgttaaggtccgtactacgtaccggcgtctctcagcaaaccgcctcaagtgtggttcagcgaactattcaaactcttgcttccaatttgggtatagatggcaataatctatcaaggatagcactgcaagctatttcgcaagtaccagcaggttctgatacatcagcctatgctcaagcgttctcaactgctttagtcactggaggagtgttaaacgcaaacaacgtcgataccctaggtagtcaagttctaagtgctgtgctcaacggagtttcatcggccgctcaaggactgggaataaatgtggacaccggatctgtacagagtgacattagatcatcatcctcttctttgtccacatcttcttcctctgcatctttcagtcaaacttccggagccgcttctaccactggttttactggcgctggtggatacccaggaggagctggaccattaggtacgtcttc

SEQ ID NO: 822 - DNA, 632 bp, Artificial Sequence
  Description of Artificial Sequence: Synthetic polynucleotide
gaagacttagcaggtggaggtgttggatctcttacaggacaaacgagtttcggtcaaacctctggcttcacaagtaccgctggagctcaaggaggattcggtccgactacaggtgctcagtccgcattgatcagtcgaatcgccaatgcattggccaatacctctaccttgagatctgtcttgagaactggtgtaagtcaacagacagcatctagtgttgttcagcgagctattcaaacgctagccagtaatttaggtatagatggcaataacttgagtaggattgccctgcaagcaatatcccaagtaccagcaggttctgacacctccgcttatgcacaggctttcagtacagctctggtgactggcggcgttttaaacgccaacaacgttgatactttgggatcacaagtgctgtccgccgtgttaaacggagtttcatcggcagcacagggtcttggtatcaacgtggacactggtagcgttcaatcagatatccgatcatcaagttccagtctgtctacatcttcctcgtcggctagtttctctcagacttcaggtgctgcttctaccacaggttttaccggtgctggtggttaccctggaggtgcaggtcctctaggtacgtcttc

SEQ ID NO: 823 - DNA, 632 bp, Artificial Sequence
  Description of Artificial Sequence: Synthetic polynucleotide
gaagacttagcaggtggaggcgtaggatcattgaccggccaaacaagctttggtcaaacttctggtttcacatcaactgctggtgctcaaggtggcttcggaccaacgacaggagctcaaagcgccttgatctccagaatagctaacgcactggctaacacatctactcttagatccgtcttgcgcacaggagtaagccaacagacagcatcaagtgtagtacagagaacgatccaaacgttggcatcgaacttgggaattgacggcaacaacctctcaagaatcgcattacaggctatatcacaagttccagctggctctgatacctcagcttatgctcaagcatttagtaccgcattagtcacaggcggagttcttaatgcaaataacgtggataccttgggttcccaggtgttgtcagctgtcttgaatggtgtgagctctgccgctcagggacttggtattaatgttgacacaggatccgttcaatccgacattagatcttcttcgtctagtctgtccacatcatcgtcatctgcctctttctcccagacatctggtgcagcttcgacaaccggatttaccggagctggtggttaccctggaggcgctggtccactaggtacgtcttc

SEQ ID NO: 824 - DNA, 632 bp, Artificial Sequence
  Description of Artificial Sequence: Synthetic polynucleotide
gaagacttagcaggtggtggagtaggaagcttgaccggtcaaacttcctttggtcagacgtccggattcactagcactgccggagcccaaggaggattcggcccaacgacaggagctcaatctgcacttatatcgagaattgctaacgcccttgccaatacttcaaccttgaggagtgtgctgagaacgggtgtttcccaacaaaccgcatcctcagtcgtgcaaagagctatccagactcttgcatccaatttgggattggatggcaacaacctctctagaatcgctcttcaagccatttcacaggtaccagcaggcttcgatgcttctgcttatgcacaagctttctcgacggcattagttacaggtggagtgctaaacgctaataatgtagatacactcggctctcaagttttatcggctgttttaaacggtgtctcatctgctgctcagggtttgggtattaacgttgatactggatcagtccaaagcgatataagatctagtagctcgagtttgtctaccagtagtagtagcgcatctttcagccagacttcaggtgctgcttctacaacaggttttaccggagctggtggttaccctggaggagcaggaccactaggtacgtcttc

SEQ ID NO: 825 - DNA, 632 bp, Artificial Sequence
  Description of Artificial Sequence: Synthetic polynucleotide
gaagacttagcaggtggaggagttggttctcttacaggtcagacttcctttggacaaacttcaggttttaccagcaccgcaggagctcaaggtggttttggaccaaccacgggcgcacaatctgccctgatttcaagaattgctaacgcattggctaacacatccactctgagatccgtgctgagaaccggagtttctcaacaaacagcttcatccgttgtccaaaggactattcaaactctcgcatcaaacttgggaattgatggaaataatttgtcgcgtatagccttgcaagcaattagtcaagtgcctgccggttcagatactagtgcatacgctcaggccttttcaacggctttggtcacaggaggagtcttaaacgcaaacaatgtggatacactaggatctcaagttttgagtgccgttttatccggagtatcctcggccgcccaaggcttaggaatcaacgttgatactggcagtgtccagtccgacattagatccagctcatcaagtttaagcacatcaagctcttccgcctccttcagtcaaacttctggagccgcatcaactacgggattcactggtgccggaggatacccgggtggtgctggtccactaggtacgtcttc

SEQ ID NO: 826 - DNA, 632 bp, Artificial Sequence
  Description of Artificial Sequence: Synthetic polynucleotide
gaagacttagcaggtggaggagtgggctccctaactggacacacatctttcggacagacctctggattcacctcaactgctggcgcccaaggaggatttggacctacaactggtgctcaatctgctttgatctcaagaattgctaatgccttggcaaatacttcaactctgagatctgtactgcgtaccggagtttcacaacagattgcctcatcggtagtccaaagaactattcaaactcttgcctctaacttaggtattgatggtaacaacttgtcgcgtatcgcactacaagcaatatcacaggttccagctggaagtgacaccagtgcttatgctcaggcttttagcacagccttagtgacgggcggtgttctaaacgctaacaatgttgacactttaggtagtcaagtgttgagtgctgttttgaacggcgtctcctcagcagcacaaggtttgggaattaacgtggacactggctcagtgcaatcagacataagaagttcatcatcctctttgagcacttcctcatcatcagcaagtttctcacaaacaagtggagctgcctctacaacaggatttacaggtgctggtggctacccgggtggagccggaccattaggtacgtcttc

SEQ ID NO: 827 - DNA, 632 bp, Artificial Sequence
  Description of Artificial Sequence: Synthetic polynucleotide
gaagacttagcaggtggcggagtaggttctctaacaggccaaacatcgtttggccagacttctggttttacatcaacagccggtgcccaaggtggcttcggacctatcacaggcgcccaatctgccctgatatcccgtatcgcgaacgctttggctaataccagtacattacgatccgtgttgcgaacaggtgtttcccaacagactgcttcgtcagtagtgcaacgtacgatacagacacttgcatccaacctcggtattgacggaaataacctgagtagaatagctttgcaggccatcagtcaggtgccagcaggtagcgacacctccgcttacgcacaagcctttagcactgctttggttactggaggtgttcttaatgccaataatgtcgataccctgggttctcaagtactttccgcagtattgaatggagtatcttctgcggctcaaggtttgggtatcaacgtggatacgggatcagttcaaagcgatattcgaagctcctcttcttctctttccaccagttctagtagcgcttcgttttcacaaacatccggcgctgcatccactaccggtttcacaggtgctggaggttatccaggtggagcaggaccattaggtacgtcttc

SEQ ID NO: 828 - DNA, 632 bp, Artificial Sequence
  Description of Artificial Sequence: Synthetic polynucleotide
gaagacttagcaggtggtggtgtcggttcgcttaccggccaaacaagttttggccaaacctctggatttacctccacagcgggtgctcagggaggattcggacctactactggtgcccaatcagctctgatttctagaatcgcaaacgcattggcaaacacatctactttaagatcggtattgcgaactggagtctctcaacaaacggccagctctgttgttcaaagaacgatccaaaccttggctagcaacttgggtatcgatggtaacaacctatcgagaattgctctgcaggccatttcccaagtgccagccggatctgatacttcagcttacgctcaagctttttctacggcacttgttactggaggtgttttgaacgctaacaacgtggacaccctaggatcccaggtcctgtcggcagttctaaacggtgtatcctccgctgcacagggattgggaataaatgttgatactggctcggtacagagtgatatcagaagcagttcgtctagcttaagtacttcttcctccagcgcaagctttagtcagacttctggtgctgcatctacgaccggtttcaccggagctggcggctacccaggaggtgccggtccattaggtacgtcttc

SEQ ID NO: 829 - DNA, 623 bp, Artificial Sequence
  Description of Artificial Sequence: Synthetic polynucleotide
gaagacttagcaggtgcaggttacacgggaccatccggcccatcgactggtccatccggttacccaggtcctctaggtggtggagctccatttggacaaagtggcttcggaggtagtgatggtcctcaaggcggttttggtgccaccggtggtgctagcgctggtttaatctcacgagttgctaacgctttggccaacacttccacactaagaactgtacttagaactggagtgtctcaacagatagcaagtagtgttgtccagagagcagcacaatctcttgctagtactttaggcgttgacggcaataatctcgccagattcgcagttcaagcagtttccagattgcccgctggatctgatacttcagcatacgcacaggcattcagtagcgccctgtttaatgccggtgtgttgaatgccagtaacatcgacaccctaggtagtagagtcctgtccgctttactaaacggtgtaagctcagctgctcaaggtttgggcatcaacgtggattctggttctgttcaaagtgatatttcgtcatcttcaagtttcttgtctaccagcagctcctcggcttcttactctcaagctagtgccagttctacttcaggtacgtcttc

SEQ ID NO: 830 - DNA, 623 bp, Artificial Sequence
  Description of Artificial Sequence: Synthetic polynucleotide
gaagacttagcaggtgcaggttacaccggtccatcaggccctagtactggtccgtccggatatccaggtttgctgggtggaggagctccatttggacaatccggatttggtggaagtgacggtccccagggtggattcggtgctacaggaggagcctcagcaggtttgatttctagagtagcgaacgcattagccaatacctcaactctgagaacggttctaagaactggtgtttcccaacaaatagcttcaagcgtcgtgcaaagggccgcacaaagtcttgctagtaccttgggagtcgacggaaacaaccttgccagattcgctgttcaagctgtttccagactacctgccggttccgatacaagtgcctatgctcaagcttttagttctgcattatttaacgcaggagttttaaacgcctccaatattgataccctcggtagtagagtattaagtgcactgctaaacggtgtcagttccgccgcccaaggtttgggcatcaatgtggactctggatctgttcaatctgacatctcttcatcatcatcttttttgtctacatcttcctcatccgcttcttattctcaggctagcgcatcaagtacctcaggtacgtcttc

SEQ ID NO: 831 - DNA, 623 bp, Artificial Sequence
  Description of Artificial Sequence: Synthetic polynucleotide
gaagacttagcaggtgctggatacacgggcccttcaggtccctctacaggacctagcggttacccaggaccactgggaggtggagctccatttggccagtccggtttcggtggcagtgacggcccccaaggcggattcggagctacaggcggtgcttccgctggtctgatatcccgtgtcgcgaacgctctggcaaacactagtacgttgagaacagttttgcgtactggcgtttcccagcagattgcttccagtgttgtacaacgagcagcccaaagtttagcttccaccttaggagtggatggtaataacctagctcgctttgcggtacaagcagttagccgccttccagcaggttccgacacgtcagcttatgcacaggctttctcatcagccctatttaatgctggagttttgaacgctagtaacatagatacattgggatcgagagtattgagtgctttattgaacggagtatcttcggctgcccaaggtctgggtataaatgtagactccggatcagtacaatcggacatctcttcgtctagtagttttctttctacaagctcttcctccgcttcttattcccaggcttctgcgagttctacttcaggtacgtcttc

SEQ ID NO: 832 - DNA, 623 bp, Artificial Sequence
  Description of Artificial Sequence: Synthetic polynucleotide
gaagacttagcaggtgctggttatactggtccatctggaccttcgacgggtccttctggttaccctggaccactgggaggcggtgcccctttcggacaatccggattcggtggaagtgccggtccacagggtggttttggtgcaaccggtggtgcttctgctggtttaatatcgagagttgccaacgctctggccaacacaagtactttacgaaccgtcctgcgaactggcgtatcccaacagatagcctcttcagtcgtacaacgtgccgctcaatccttggcttcgaccttgggagtggacggtaacaatcttgctagatttgctgttcaagctgtcagtagacttcctgctggaagtgataccagtgcttatgcacaagcattcagtagtgctttgtttaacgctggagtcttgaatgcctcaaacattgatactcttggttcacgtgttctatctgctttattaaacggtgtgagctcagccgcacaaggattaggaataaacgttgattccggaagcgtgcagtcagacatttcctctagctcaagctttttgagtactagtagctcttcagccagttactcccaagcctcagcatcctcaacttcaggtacgtcttc

SEQ ID NO: 833 - DNA, 623 bp, Artificial Sequence
  Description of Artificial Sequence: Synthetic polynucleotide
gaagacttagcaggtgcgggttatactggcccgtcaggtcctagtactggaccatctggttatccaggtccattaggaggtggtgctccatttggacaatctggtttcggaggttcagctggaccacaaggaggctttggtgcaactggaggtgcatccgccggattgatttcaagggtagcaaatgctttggcgaacacctccactcttagaacggttctccgaacaggtgttagtcagcaaatcgctagttccgtggtccaaagagccgcccagagtttggcatcaactttgggagttgatggaaataatttggcgagatttgccgttcaagctgtgtctagactaccggcaggaagcgatacttctgcgtacgcccaagccttctcatccgctttgttcaacgctggagtgttgaatgctagtaacatcgataccctgggcagtagggtcttgtcagcactgctcaatggtgtgtcgagtgctgcccaaggattgggtatcaatgtcgacagtggttcagtccaatccgatatctcttcgtcatcttcatttctaagtacgagctcttcctcagcttcatactcccaagcttcagcttcttccacctcaggtacgtcttc

SEQ ID NO: 834 - DNA, 623 bp, Artificial Sequence
  Description of Artificial Sequence: Synthetic polynucleotide
gaagacttagcaggtactggttacactggacctagtggtccttcaactggaccatcaggatatccaggaccactgggtggtggtgctccctttggacaatctggatttggaggctcagctggacctcaaggcggtttcggtgctactggtggagctagcgctggtttgatttccagagttgccaacgcactggcaaatacatccacattgagaactgtactcaggaccggtgtcagccaacagatcgcttcttcagtcgttcaaagggctgcccaatcattggcaagcactctgggcgttgatggtaacaatttagctagattcgcagtccaagctgtgtccaggctgccagctggttcagatacctccgcatatgcgcaggcattcagtagcgctctgtttaatgcaggagtattgaatgcttcaaatattgatactctcggtagcagagtcttatccgcattactcaatggagtatcatccgccgcgcaaggtttaggaataaatgtcgattccggttctgttcagtccgacatctcatcttcatcatcgttcctcagtacttcctcctcttcagcgagttactcccaggccagcgcctcttctacgtcaggtacgtcttc

SEQ ID NO: 835 - DNA, 623 bp, Artificial Sequence
  Description of Artificial Sequence: Synthetic polynucleotide
gaagacttagcaggtgcaggatataccggaccttccggaccatcaacgggtcctagtggttatccaggacctctaggaggtggcgccccttttggtcagagtggttttggtggttcagcaggaccccagggaggattcggagctactggtggtgcatcagctggtttgattagcagagtagcaaacgccctagcaaatacatcgactctaagaacagttttgagaacaggtgtctctcaacaaattgcttcctccgtcgttcaacgtgcagctcagtcattggcatctactttaggtgtggatggaaataatttggctagattcgccgtccaagctgtgtctcggctaccagccggctcggacacttcagcttacgcccaggctttctcatccgcactgttcaatgctggagtactaaacgcttcgaacatagatacgctcggatctagagttctaagcgccttgctgaatggtgtcagctccgcagcccaaggacttggaataaacgttgactcaggaagcgttcagtcggacatcagtagtagctcatcattcctgtccacctctagctcgtccgctagctacagtcaagccagtgcctcctccacttcaggtacgtcttc

SEQ ID NO: 836 - DNA, 623 bp, Artificial Sequence
  Description of Artificial Sequence: Synthetic polynucleotide
gaagacttagcaggtgcgggttacaccggaccgtcaggtcctagtactggcccgtccggttacccaggaccattaggcggtggcgcaccttttggtcagtcaggttttggaggctctgatggtcctcaaggaggattcggcgccacaggtggagcctctgctggactaatctcccgtgtggccaacgctctagcgaacacatccactttgaggactgtgctaagaaccggagtatcccagcaaatcgcatctagcgttgtgcagagggccgcacaatcactagcatctactttgggtgtagatggaaataatctggctagattcgccgttcaggccgttagcagactcccagccggttcagatacttctgcttatgctcaagcgttctcatccgccttgttcaacgccggcgttctaaacgcctctaacattgataccttaggttcaagagtcctaagtgccttacttaacggagtttcttccgctgcccaaggacttggtatcaacgtcgattctggttcggttcaaagcgatatttcaagctcctcttccttcttgtcaacttccagctcatctgctagctacagccaagcttcggcaagcagtacatcaggtacgtcttc

SEQ ID NO: 837 - DNA, 590 bp, Artificial Sequence
  Description of Artificial Sequence: Synthetic polynucleotide
gaagacttagcaggtttcaccggagcaagctatcccggtccacaagtctcacagcctgcacctttcggcgtcggcccacaaccaggaggtgctctacctggttttggacaagtatctggagctcaaagtgcccttatttctagaatcgccaacgctttgggtaacaccgctactatgcgagctgtcttgcgcagcggagtgagtcaacaaattgtctcaaatgttgttcaaggagctgtgcaggcattatcatccagtctgggaattgatggtaataacttggcaaggattgcttctcagaccatactcagagtacctgctggttcggacactagcgcatacgctcaagcattttctactgccctgttcaattcgggtgttttgaacgctagtaatgtgaacacattgggctcccaggtggtatcgacgttgctgcgtggcatctcatcaacggcacaaggtcttggattaaacgtcgacgcaggttccgttcaatccgatataagttctagtagttcctttctgtctacttcctcgtcctccacctcatcttcacaaacaactgcagcaagtacgtcaggtacgtcttc

SEQ ID NO: 838 - DNA, 590 bp, Artificial Sequence
  Description of Artificial Sequence: Synthetic polynucleotide
gaagacttagcaggtttcactggagcttcatatccaggaccacaggtgtcacagcctgcacctttcggtgttggtccacaaccaggtggtgcgttaccaggttttggccaagtttctggtgcacaatctgcacttatttcgagaattgcaaatgctctcggaaataccgctaccatgagagcagtgctgagaagcggtgtctcacaacaaatagtctctaacgtagttcagggagctgtacaagctttgtcctcatcacttggaattgatggaaataacctggcacgaatcgcttcgcagactatattacgagtgccagccggaagtgatacttcagcttacgctcaggctttctctactgccttgttcaattcaggagtattgaacgcgtcgaatgttaatacccttggttcgcaagttgtttccacactgctacgaggtatttctaacactgcacagggtctaggactgaatgtagacgctggtagtgtacagagcgacatctcttcatcctcttcgtttctaagcacctcatcttcctctaccagctcaagtcaaacgacggccgcatcgacttcaggtacgtcttc

SEQ ID NO: 839 - DNA, 554 bp, Artificial Sequence
  Description of Artificial Sequence: Synthetic polynucleotide
gaagacttagcaggtgcctcggctgctgatatcgcaactgcaattgctgcaagtgttgccacctccttgcaatccaatggagtactaaccgcctccaacgtgagtcaattgtctaatcagctggcatcttatgtttcttccggtctgtcctctacggcaagttcattaggaattcaattaggtgcctcccttggagccggcttcggagctagcgctggtcttagcgcctctaccgacatcagcagttccgtagaggccacttccgcttctactctatcatcaagtgcaagtagtacttcagtcgtatcaagtattaacgctcaactcgtgcccgcgttggcacagacagccgttcttaacgccgctttttctaacatcaacactcagaacgcgatccgaattgcagaactgttaacacagcaagtcggaaggcagtacggattaagtggaagcgacgtcgcaacggcatcgtcccagattagatctgctctatactctgttcaacagggttcggcttcatctgcatacgtcagcgcgattgtaggtacgtcttc

SEQ ID NO: 840 - DNA, 563 bp, Artificial Sequence
  Description of Artificial Sequence: Synthetic polynucleotide
gaagacttagcaggtcctctaataacagcactcagctcacgcggagtagtgaatgcttctaattcatcacagattgcatcgtccttagctacagctattctgcagtttactgcaaacgtggcaccacaattcggtatcagcattcccaccagcgcagtgcagtccgatctatctactattagtcagtccttgacggctatttcttctcagacctcctcaagcgttgattcttcgacgtctgcattcggtggaatcagtggtccgagtggcccatctccatacggaccacaaccatccggtcctacttttggtccaggcccaagtctttctggccttactggcttcactgctaccttcgctagctctttcaagtcgacacttgcttcgtcaacccagtttcaattgatcgctcaatccaacttggacgtgcagacaagatctagcttgattagtaaagtattgataaacgctttgtcctcactaggtatctccgcctcggtagcctcttcgatagccgcatcttcttcccaatctttgctgagcgtttctgcaggtacgtcttc

SEQ ID NO: 841 - DNA, 554 bp, Artificial Sequence
  Description of Artificial Sequence: Synthetic polynucleotide
gaagacttagcaggtgcttccgcggccgatatagcaaccgcaattgcagcatctgtagctacttcattacagagtaacggtgtcttgacggcatcaaacgtatctcaattgtcgaaccaattagcaagttatgtgagtagtggtttgtcaagcactgcatccagtttgggtatccaactcggcgctagcttgggtgctggtttcggtgctagcgccggattatctgctagtaccgacatctcctcgtcagtggaagcaacttcggcttcgactctgtcaagttccgcatcttccacgtcagttgttagttcaattaacgctcagctagttccagctctcgctcagaccgccgtgctgaatgccgccttttctaacattaatacccagaacgctatcagaatagctgaacttctgactcaacaagtaggcagacagtacggattgagtggttccgacgttgctaccgcatcctctcaaattagaagtgctctctatagtgtacaacagggtagtgcttcttccgcttatgtctcagccattgtaggtacgtcttc

SEQ ID NO: 842 - DNA, 563 bp, Artificial Sequence
  Description of Artificial Sequence: Synthetic polynucleotide
gaagacttagcaggtccgttgataactgctttgtcgtcaagaggtgtcgttaacgcctctaactctagtcagattgcttcctctctggcaacagctattctgcaattcactgctaatgtggctccacagtttggaatctctattccaaccagtgctgttcagtctgatcttagtactattagtcaatccctaactgcaatatcttcccaaacctcgtcatctgtcgattcctctacatccgcattcggtggcatcagtggtccttccggtcctagcccatatggccctcaaccttctggtcccacattcggtcctggcccatcattatctggattgaccggattcaccgctacatttgcctcgtcgttcaagagcactttagcatctagtacacaatttcagttgatcgcccagagtaatttggacgttcaaacaagaagtagcctcatatctaaagttttaattaatgcactgagtagtctgggtatatctgccagcgttgctagctcgatagctgcaagttcctctcagtctctactcagcgttagtgcaggtacgtcttc

SEQ ID NO: 843 - DNA, 536 bp, Artificial Sequence
  Description of Artificial Sequence: Synthetic polynucleotide
gaagacttagcaggtcctggttacggttacgctgcttactatgctgctaattatggctatggtcctggagtaggcgccggttctggtgcgggagccggctcaggctctggagtcggagcaggttcaggatttggagcaggtgcaggatcaggtactggactaggtagaggagctggaactggtgctggagcgggatctggagctggttcgggtgccggtgccggaagcggttctggtgctggtgcgggaagtggcagtggagcaggtgccggaagaggtgctggactcggaggttttggctctggattaggagccggagcaggaacaggagccggagctggttccggaagtggagccggcagcggagctggtgcaggcgctggatccggatttggtgcaggtgctggaagaggagctggttctggtggaacaggttcctggttgagatccggcgtcggtactggttcttctgcttctgccggctctgcaggatcaggtgcaggagtaggatctggtgctggtccaggtacgtcttc

SEQ ID NO: 844 - DNA, 530 bp, Artificial Sequence
  Description of Artificial Sequence: Synthetic polynucleotide
gaagacttagcaggtcctgcatacggatatgctgcctactacgctgccaactatggttacggaccgggtgtaggtgccggttccggtgccggagctggttccggtagcggtgcaggtgctggttcgggttcaggtgctggtgctggctcaggagctggattaggtagaggtgcgggaaccggagcaggtgccggttcaggtgctggatccggcgccggagctggttctggtagtggcgctggtgccggttcaggatcaggagccggagcaggtcgtggtgccggattaggtggtttaggctccggtttgggagctggtgcaggtacgggtgccggatcgggatctggatccggtgccggatccggagccggagctggtgctggaagcggttctggcgcaggagctggtagaggagccggatccggattaggagcaggtttgggctctggtgttggaactggatcaggtgctggagctggcgctggatcaggagctggtgttggttcaggcgctggagcaggtacgtcttc

SEQ ID NO: 845 - DNA, 515 bp, Artificial Sequence
  Description of Artificial Sequence: Synthetic polynucleotide
gaagacttagcaggtccaggctacggatacgctgcatactatgccgcaaattacggatatggtccaggagtcggtgctggtagcggagctggtgctggaagtggatctggtgccggagcaggtagtggaagcggagcaggtgcaggttctggagccggtctgggtagaggagctggtactggcgctggagctggttctggagccggatcgggtgctggagctggatctggcagtggagcaggagccggatccggatctggtgctggagccggtagaggagccggtctaggtggactaggagcaggtttaggagccggagctggatctggtgcaggtgccggatccggcgcaggagctggtgctggcagtggttctggtgccggagctggtagaggtgctggactaggtggtcttggcgctggtctaggttccggtgttggtacaggcgctggtgcaggagctggcgccggttcaggtgcaggagccggatctggagccggtgcaggtacgtcttc

SEQ ID NO: 846 - DNA, 527 bp, Artificial Sequence
  Description of Artificial Sequence: Synthetic polynucleotide
gaagacttagcaggtccaggttacggttatgcagcttattatgctgccaattatggttacggacctggtgttggtgcaggttcaggagccggtgccggatcaggtagtggctcgggtgctggagccggatctggttctggtgctgcagctggaagtggagccggattaggtagaggtgctggtacaggtgctggagcaggttcaggagctggttcaggtgccggatctggtgcgggtgctggatcaggtagtggagcaggagctggtcgaggtgccggtcttggtagactgggttcaggtttaggcgctggcagtggtaccggagctggagctggatcaggttctggtgctggttctggcgctggcgcaggagccggtagtggaagcggcgctggtgcgggtcttggtgctggactaggaggactgggcgccggcttggtttccggagtcggtacaggcgccggagccggagccggagctggcagcggagcaggtgcaggaagtggagccggtgcaggtacgtcttc

SEQ ID NO: 847 - DNA, 527 bp, Artificial Sequence
  Description of Artificial Sequence: Synthetic polynucleotide
gaagacttagcaggtaaggccattagttccggtgctgccagtgccgcagcttctgcttctgctgcatcagcggccgctacagctgtggctgctgcttcattcagtgcttcaaccaccacgaccgccacctcaacgtcagccgctgctactggtgccgctgctgctgccggaggagaggctgctgcagtttcgagcactgcctcgtcatcatttttacaggctttggtgtcctcaatccttgaaagaccagagtttttggttccactaagtcacgctacttccgcttcttccgcttacgccatcacctcaacaattgtcagggacgcagcatacgaaaccgaattcagtaaatgggcaactcagatgagcagtgcggctgcgaaagaggttgctgaggttggaagcggagctagcgcctatgactatgcatatgccatggctcgtggtttgactaaatgtctatcgagatacaacttgattaacagccaagaccctactccttctgctagaaaattaggtacgtcttc

SEQ ID NO: 848 - DNA, 593 bp, Artificial Sequence
  Description of Artificial Sequence: Synthetic polynucleotide
gaagacttagcaggtggacaaggtggacaaggtggctacggaggtttgggttcgcaaggtgctggtcagggcggatatggagctggtcaaggtgcagccgccgcagctgcagctgctggtggcgcaggtggcgctggaagaggaggacttggtgctggtggtgctggtcaaggttacggcgctggtctaggaggacaaggaggtgcaggtcaagctgccgccgcagccgctgccggaggagctggtggcgctaggcagggaggtctgggagctggtggtgccggtcaaggatacggtgctggtttaggcggtcaaggcggtgctggacaaggaggagccgctgccgccgctgctgctgctggtggacaaggcggtcaaggaggttatggtggtctgggttctcaaggtgctggacaaggcggttacggtgccggacaaggtggtgccgcagctgctgctgctgctgccggtggccaaggaggtcaaggtggttatggtggattgggatcacagggtgctggtcagggtggctatggaggaaggcaaggtggagccggcgccgctgctgcggctgctgctgcaggtacgtcttc

SEQ ID NO: 849 - DNA, 677 bp, Artificial Sequence
  Description of Artificial Sequence: Synthetic polynucleotide
gaagacttagcaggtggctatggtcctggagccggtcaacaaggaccaggaggagcgggtcagcaaggccccggatcccaaggtccaggtggagctggacaacaaggacctggaggacaaggtccatatggtccaggagctgccgctgccgctgcagccgtcggtggctatggacctggagctggtcaacaaggtcctggttcccagggtcctggctctggaggtcaacaaggccctggaggtcaaggaccatacggaccgtcggcagcagcagccgcagcagccgctggtggatacggaccaggagcaggccaacaaggtccaggttctcaaggaccaggatcgggcggtcagcagggtccaggtggtttaggcccttacggacctagtgcagctgccgcagctgccgctgctggaggctacggccccggagcgggacaacagggtcctggatctcaaggaccaggttcaggaggtcaacagcgacctggtggattgggtccatacggtccttccgctgctgcagcagcagcagcggccggaggatatggccctggagccggacaacaaggtccaggatctcaaggccctggaagcggaggacaacaaagaccaggaggtttgggaccttatggtccatcagctgccgctgcagctgctgcagcaggtacgtcttc

SEQ ID NO: 850 - DNA, 857 bp, Artificial Sequence
  Description of Artificial Sequence: Synthetic polynucleotide
gaagacttagcaggtagtgcgccacaaggtgcaggtggtccagcgccacaaggtccttcccagcaaggaccagttagccagggtccatatggaccaggtgctgcagccgctgctgctgctgcaggtggttacggaccaggtgccggacaacaaggcccaggtagccagggaccaggtagtggaggacaacagggtccgggatcacagggaccaggatcaggtggccaacagggtcctggtggacaaggcccatatggtccatcggccgccgccgccgccgcagctgcagctggaggatacggaccaggagccggtcaacagggacctggttcccaaggtccaggttccggtggccaacagggacctggcggacaaggtccttacggtcctggcgcagctgctgctgccgcagctgttggtggttacggacctggtgctggacaacaaggccctggatctcaaggtccaggatccggaggtcaacaaggacctggaggacaaggaccttatggtcctagtgcggcagcagcagctgctgcagccggaggttatggaccaggtgctggtcaacaaggtccaggttcacaaggtcccggttctggtggacaacagggtccaggtggacagggtccatacggaccttcagctgccgcagctgccgctgccgcaggaggttacggtcccggagctggtcagcaaggtcctggatctggaggacagcaaggtccaggtggacaaggaccatacggctccggccagcagggaccaggtggtgcaggacaacagggcccaggcggacaaggaccttacggaccaggtgcagctgcagctgctgctgcagcagcaggtacgtcttc

SEQ ID NO: 851 - DNA, 776 bp, Artificial Sequence
  Description of Artificial Sequence: Synthetic polynucleotide
gaagacttagcaggtggttacggtcccggagctggacaacaaggacccggaggtgccggacagcaaggacctggttctcaaggacctggaggtcaaggaccatatggcccaggagccggacaacaaggtcctggtagccagggaccaggttcgggtggtcaacaaggtccgggaggtcaaggcccatacggtccatccgcagctgcagcagcagctgctgccggcggttatggtcctggtgccggccagcaaggaccaggttcacagggcccaggttctggaggtcaacaaggtcctggatctcaaggtcctggtagtggtggccaacaaggaccaggtggacaaggcccatatggcccttccgccgctgctgctgcagcagcggccggaggatatggtccaggagcaggtcagcagggtccaggttctcaaggaccaggctctggcggtcagcagggacctggtggtcaaggaccttatggaccaggagcagctgccgcagccgctgctgtcggaggttacggacctggagcaggtcaacagggtccaggatcgcagggaccaggatccggtggacagcaaggtccaggcggacaaggaccttacggaccatcagctgccgctgccgcggccgctgctggaggttatggaccaggcgcaggtcaacaaggacctggtagccaaggccctggtagtggtggacaacagggtccaggtggtcaaggtccatatggtccatccgcagcggctgctgctgctgccgcaggtacgtcttc

SEQ ID NO: 852 - DNA, 707 bp, Artificial Sequence
  Description of Artificial Sequence: Synthetic polynucleotide
gaagacttagcaggtggatatggacctggcgctggtcagcaaggtcctggatctggaggacagcagggacctggtggacaaggtccatatggcagcggtcaacaaggaccaggtggagcaggtcaacaaggacctggaggtcagggaccttatggccctggtgcagccgcagccgcggccgccgctgctggtggttacggaccaggcgcaggtcaacaaggtcctggcggtgctggacaacagggcccaggttcccagggcccgggtggtcaaggtccatatggtcctggagcaggacaacagggtcctggttctcagggtccaggtagtggcggtcaacaaggtccaggaggccaaggtccttacggcccatcagccgcagcggctgccgctgctgctgccggtggttacggacccggtgctggtcaacgaagtcaaggtccaggaggtcagggtccatacggtccaggtgcaggtcagcagggaccaggatctcaaggtccaggttcaggaggccaacaaggcccaggaggtcagggaccatatggtccatctgctgctgctgctgccgctgccgcaggacctggtgctggtagacaaggtcctggtagccaaggtcctggatccggaggtcagcaaggcccgggcggtcagggtccatatggaccatcggctgctgccgcagctgctgctgcaggtacgtcttc

SEQ ID NO: 853 - DNA, 794 bp, Artificial Sequence
  Description of Artificial Sequence: Synthetic polynucleotide
gaagacttagcaggtcctggagcaagaaggcaaggtccaggtagtcagggcccaggttcgggtggtcaacaaggaccaggtggtcagggtccatatggtagtggccagcaaggtccaggtggcgccggtcaacaaggtccaggcggacaaggaccttacggtccaggcgctgccgccgcagcggctgcagccgcaggtggctatggtcctggtgctggccaacaaggaccaggaggagctggccaacagggaccaggaagtcaaggacctggaggacagggaccatatggtccaggagcaggacaacaaggtccgggctcccagggtccgggatctggaggacaacagggccctggaggacaaggtccatatggaccttcggccgccgcagctgcagctgccgcaggaggatatggccctggtgctggacaacagggacctggatcccaaggacctggtagtggaggtcaacaaggcccaggaggacaaggtccttacggtcccggtgcagctgccgctgctgccgctgtaggcggttacggaccaggagcaggtcaacaaggtcctggttctcaaggacctggttcaggaggacaacagggtccaggcggtcaaggcccttatggaccatccgctgctgctgctgcagctgcggcaggtggctacggtcctggtgccggacaacaaggtccaggatctcagggacctggttccggaggacaacaaggaccgggaggacaaggtccgtatggtccttctgctgccgcagccgcggctgctgcaggtacgtcttc

SEQ ID NO: 854 - DNA, 788 bp, Artificial Sequence
  Description of Artificial Sequence: Synthetic polynucleotide
gaagacttagcaggtggatacggaccaggtgcaggacaacaaggccctggttccggtggacaacaaggaccaggtggacagggcccttacggctcaggtcagcaaggtccaggaggagcaggtcaacagggtcctggtggtcaaggaccttatggaccaggagctgctgccgcggcagcagcagctgccggaggttacggtccaggtgccggacaacagggtcctggaggtgctggacagcagggtccagagggaccaggttcccaaggtcctggatctggtggtcaacaaggaccaggaggtcagggcccttacggtccaggagctgcagccgctgctgctgcggtcggaggttacggacctggagctggacaacaaggacctggttcacagggacctggaagtggtggtcaacaaggtcctggaggccaaggcccatacggtccatcagctgccgctgccgcagctgctgccggtggttatggtcctggtgctggtcaacaaggtccaggatcgcaaggcccgggatcgggtggacaacagggtccgggaggtcagggaccatatggcccaagtgccgctgcagcagccgccgcagctggtggatatggaccaggagcaggtcaacaaggacctggatccggtggacaacagggaccaggtggacaaggaccatatggatctggtcaacagggaccaggaggtgctggccagcaaggccctggtggtcaaggaccatatggtccaggagcggccgctgctgcggccgctgctgcaggtacgtcttc

SEQ ID NO: 855 - DNA, 779 bp, Artificial Sequence
  Description of Artificial Sequence: Synthetic polynucleotide
gaagacttagcaggtggatacggtccgggtgcgggtcaacagggaccaggtggagctggtcaacagggacctggatcacaaggacctggaggtcaaggcccttatggtcccggtgcaggacaacaaggacctggatcgcaaggtcctggatctggaggacagcaaggtcctggtggccaaggcccatacggtccatcagccgcagctgccgcagctgctgccggaggttatggaccaggtgctggtcaacaaggcccgggttcacaaggacctggtagtggtggtcagcaaggaccaggtagtcagggaccaggatcaggtggacaacaaggtccgggtggtcaaggtccatatggaccgtccgctgcggctgcagcagctgctgccgcaggaggttacggacctggcgctggtcaacagggtccaggttcccaaggacctggttctggaggtcaacaaggtccaggtggacagggcccatacggaccaggagcagccgccgccgcagctgctgtgggtggttatggtccaggtgccggacagcaaggaccaggatcccaaggaccaggttctggcggccaacagggtccaggaggccagggcccttatggaccaagtgctgccgcagccgccgcagcagcgggtggttacggtccaggtgccggtcaacaaggaccaggatctcaaggtccaggttccggcggtcaacaaggcccaggaggtcagggtccttatggaccatcggcagctgctgctgctgcagcggcaggtacgtcttc

SEQ ID NO: 856 - DNA, 806 bp, Artificial Sequence
  Description of Artificial Sequence: Synthetic polynucleotide
gaagacttagcaggtggttacggtccgggcgctggacaacaaggaccaggttctggtggacaacaaggtcccggtggacaaggtccttacggttcaggccagcaaggtccgggaggagctggtcaacaaggaccaggcggtcaaggtccatacggaccgggagcagcagctgcagcagcagccgctgctggtggatatggtcccggagctggtcaacagggacctggaggagccggacaacaaggacctggtagtcaaggtcctggtggacaaggtccatacggcccaggagcaggtcagcaaggtccgggttctcaaggtcctggctcaggtggacaacaaggcccaggtggacaaggaccatatggtccttctgctgctgccgctgctgcagcagcaggaggatatggaccaggtgctggtcaacagggtccaggttctcagggcccgggttccggaggacagcaaggaccaggcggacaaggcccttacggaccgtcggccgccgctgcggctgctgcagcaggaggatacggtcctggcgcgggtcaacaaggtcctggatctggcggtcagcaaggtccaggaggtcaaggaccatacggttctggtcaacaaggcccaggaggagctggacagcagggccctggaggtcaaggtccttacggtggcggttatggtccaggtgctggacaacagggtcctggatcgcagggaccaggaagtggcggtcaacaaggtccaggtggtcaaggtccttatggtcctagcgccgctgcagctgcagctgcagcaggtacgtcttc

SEQ ID NO: 857 - DNA, 797 bp, Artificial Sequence
  Description of Artificial Sequence: Synthetic polynucleotide
gaagacttagcaggtccaggagcccgtagacaaggtccgggctcacaaggtccaggatctggtggacaacaaggaccaggtggccaaggcccatacggatctggacaacagggtcctggtggagctggtcaacagggtccgggcggtcagggcccctacggtccaggagcagcagctgctgcggctgctgcagcaggaggatatggacctggagccggtcaacagggacctggaggtgctggccagcagggtcctggttctcagggaccaggtggtcagggtccatacggcccaggcgccggtcagcaaggaccaggttcacaaggcccaggctctggaggtcagcaaggacccggaggtcaaggtccttatggtccaagtgccgctgctgctgctgctgcagctgcaggaggatacggtccgggagctggtcagcaaggacctggttcgcaaggtcctggtagtggtggccaacaaggtccaggtggtcaaggaccgtacggtccaggagctgcagctgccgccgctgctgtaggaggatacggtccaggtgctggtcaacaaggtcctggaagtcaaggtccaggatccggaggtcagcagggacctggtggacaaggaccttatggtccttctgcagcagctgcagcggctgccgctggtggatatggtcctggagctggacagcagggcccaggatctcagggcccgggttctggaggacaacaaggacctggtggacagggtccatacggaccttccgctgccgccgcggcagctgcagcaggtacgtcttc

SEQ ID NO: 858 - DNA, 755 bp, Artificial Sequence
  Description of Artificial Sequence: Synthetic polynucleotide
gaagacttagcaggtggtcagggaggaagaggaggattcggaggtctaggatcacagggcgagggaggagccggacagggaggtgcaggcgcagctgcagctgctgccgctgcaggagctgatggtggtttcggtctaggaggctacggagctggacgaggttatggagcaggactaggaggtgcaggtggagctggtgctgcttcagctgccgctgccgctggtggtcaaggtggaaggtctggtttcggtggcctgggttctcaaggagccggcggtgcgggtcaaggaggtgccggcgctgccgccgcagctgctgcagctggtgccgacggtggctctggtctgggaggatatggagctggacgtggttatggagctagcttgggtggagctgatggtgctggagctgcctccgcggcagccgccgctggaggacaaggtggcaggggtggttttggtggtttgggctctcaaggagcaggtggtgcgggacaaggtggtgccggtgctgctgccgccgctgctgctgcatctggagacggaggttctggattaggaggttatggtgccggaagaggatacggcgctggtcttggaggcgctggcggtgctggtgccgcttctgccgcagctgctgccggtggtgaaggaggacgtggaggttttggaggactcggatctcagggcgctggtggtgcaggacaaggtggctccctcgcggcggccgcagccgcagccgcaggtacgtcttc

SEQ ID NO: 859 - DNA, 746 bp, Artificial Sequence
  Description of Artificial Sequence: Synthetic polynucleotide
gaagacttagcaggtgctgatggcggttcaggacttggaggttacggtgccggtagaggttacggagcaggactaggtggagctgatggagccggtgccgcttctgctgcagccgccgcaggaggacaaggtggtagaggtggttttggtagactcggttcgcaaggagctggaggagcaggtcaaggtggagctggcgcagccgctgcggttgccgcggcgggaggtgacggaggttcaggtcttggcggttacggcgctggtagaggatacggcgctggtttaggtggtgctggcggagctggagccgcatccgctgcggccgccgctggaggccaaggcggccgaggaggtttcggtggactgggatcacaaggagctggtggagctggccagggaggtgctggcgcagccgcctcgggagatggaggtagcggactaggtggatacggagctggccgtggttacggagctggattgggaggcgctgatggtgctggtgccgcttcagctgcttcagcagccggtggccaaggaggtaggggtggttttggaggactcggaagtcaaggagcaggaggagccggtcaaggcggtgctggtgcggccgccgctgcagctactgccggtggtgatggaggctccggactaggaggttatggtgccggaagaggttacggtgcgggcctgggcggtgctggaggtgcaggtgctgcttcggccgcagccgccgcaggtacgtcttc

SEQ ID NO: 860 - DNA, 863 bp, Artificial Sequence
  Description of Artificial Sequence: Synthetic polynucleotide
gaagacttagcaggtggacagggcggaagaggaggttttggaggattgggatcccaaggtgctggaggagccggacagggtggcgctggagcagctgctgccgcagctgctgctggaggtgacggaggttccggtttaggcggttacggcgccggtcgaggacacggagtaggtcttggaggtgccggtggtgcgggtgccgcttccgctgctgcagctgccggtggtcaaggaggacgcggaggtttcggaggacttggatctcaaggtgctggtggtgccggtcaaggtggtgctggtgccgctgcagcggctgctgcagctggtggtgatggcggttcaggtttgggaggatacggtgcaggtagaggtcacggtgctggtttgggcggtgccggaggcgcaggtgctgcctctgcagcggcagcagctggaggtcaaggtggaagaggaggatttggtggcctgggttcgcaaggctccggtggagcaggtcagggaggatctggagctgctgctgcagccgctgctgcaggcggagacggtggttctggcttgggtggttatggagccggtcgtggttatggcgcaggtctgggtggtgctggcggagctggcgcagcttccgctgcggctgccgccggaggccagggtggaaggggaggattcggaggattaggatcgcaaggtgccggtggcgccggacaaggaggatcaggagctgctgctgccgctgccgcagccgtcgctgacggtggatctggtttgggaggatatggtgcaggcaggggatacggagctggattaggaggtgcaggaggtgctggtgcagcttcagcagccgctgccacaggtacgtcttc

SEQ ID NO: 861 - DNA, 716 bp, Artificial Sequence
  Description of Artificial Sequence: Synthetic polynucleotide
gaagacttagcaggtggtcaaggcggacaaggaggatatgacggactaggtagccaaggtgcaggtcaaggaggttacggtcagggaggagccgctgcggcggctgcagctgcctctggtgcaggatccgctcaaagaggaggtttgggtgcaggtggtgccggacaaggttacggtgccggatccggcggtcaaggaggcgcaggtcaaggaggcgccgctgcagccactgctgctgccgctggtggacaaggcggtcaaggtggttacggtggattgggatctcaaggatcaggccaaggcggctacggccaaggaggtgctgctgctgctgcggctgccgcatcaggtgacggaggagctggtcaagaaggacttggtgctggtggagctggacaaggttatggcgccggtcttggtggacagggtggcgcaggacagggtggtgctgccgccgctgctgctgcagccgctggaggtcaaggcggtcagggcggatatggtggcttaggctctcaaggtgctggacaaggtggttatggacaaggtggtgcagctgcagctgctgctgcggcctctggagctggtggtgctggccaaggaggtctaggcgcagctggcgctggtcaaggttacggagcaggatctggcggacaaggtggtgccggtcaaggtggagctgctgcagcagctgccgcagcagcaggtacgtcttc

SEQ ID NO: 862 - DNA, 716 bp, Artificial Sequence
  Description of Artificial Sequence: Synthetic polynucleotide
gaagacttagcaggtggacaaggaggtcaaggaggttacggtggattgggttctcagggagctggtcaaggtggatacggacagggaggtgttgctgcagctgcggctgctgccagcggtgcaggaggagccggacgtggtggtctgggcgctggtggtgccggtcaagaatacggagcagtttctggtggacaaggaggtgcgggtcagggaggtgaggctgcagctgctgcagcagctgccggtggccagggaggacaaggtggctatggtggactcggtagtcaaggagcgggtcaaggcggatatggtcaaggtggtgctgccgcagctgccgctgcagcctccggtgccggaggtgctagacgtggtggattaggagctggaggtgcaggacaaggatatggtgccggattgggtggacaaggtggagccggtcaaggaagcgcttcagccgccgcagctgctgcagctggaggacagggaggtcaaggtggatatggcggacttggtagtcaaggcagtggtcaaggtggttatggacagggcggtgccgctgctgctgcagccgctgcatcgggtgctggaggtgccggccgaggatctttgggagccggaggcgccggacaaggttacggtgctggacttggtggtcaaggtggagcaggtcagggtggtgccgctgctgccgcttctgctgcagcaggtacgtcttc

SEQ ID NO: 863 - DNA, 428 bp, Artificial Sequence
  Description of Artificial Sequence: Synthetic polynucleotide
gaagacttagcaggtggttatggtcctggagccggacagcagggacagcaagcgggtcaaggttccggacagcagggcccaggtggtgcaggacaaggtggtccacgaggtcagggaccttatggacctggagcagctaccgctgcagcagcagctgcaggacctggttacggtcctggagctggacaacaaggtccgggttcgcaaggtcctggttcaggaggacagcaaggacctggttcacaaggtccttatggcccatctgctgctgccgctgctgccgcagcaggaccaggttacggacctggtgctggtcaacaaggtcctggtagtcagggccctagaagtggaggacaacaaggccctggtggacaaggaccttacggtccttccgccgctgctgctgccgccgcagcaggtacgtcttc

SEQ ID NO: 864 - DNA, 443 bp, Artificial Sequence
  Description of Artificial Sequence: Synthetic polynucleotide
gaagacttagcaggtccaggttatggaccaggagctggtcagcagggccctggttccggtggacaacaaggtggaccaggctctggccaacagggcccaggtggtgccggtcaaggaggacctagaggtcaaggtccatatggtccaggtgcagctgccgccgccgcagctgcagctggtggatatggaccaggtgctggccagcagggaccaggttctcagggacctggtagcggtggccaacagggaccaggaagtcagggcccatatggacctagtgctgctgcagctgctgctgccgcgggtccgggatatggcccaggagcaggacagcaaggccctggctctcaaggccctggttcaggtggacagcaaggtccaggaggacaaggaccttatggtccatctgcagctgctgccgctgcagcagcaggtacgtcttc

SEQ ID NO: 865 - DNA, 443 bp, Artificial Sequence
  Description of Artificial Sequence: Synthetic polynucleotide
gaagacttagcaggtccaggatatggaccaggtgcaggacagcagggaccgggatcaggaggacaacaaggcggtcaaggttcaggtcaacaaggtccaggaggtgctggccagggaggtcctagaggtcaaggaccatatggacctggtgccgctgcggctgccgcagctgcagcaggtggttacggtccaggtgccggacagcaaggcccaggatcacagggtccaggttctggtggtcagcagggtccgggttcgcaaggaccctatggtccatcagccgcagctgctgctgccgcagctggtccaggttacggacctggtgctggccaacaaggaccaggcagtcagggtccaggtagtggtggtcaacaaggcccaggtggtcaaggaccttacggtccatctgctgctgccgctgctgcggcagcaggtacgtcttc

SEQ ID NO: 866 - DNA, 440 bp, Artificial Sequence
  Description of Artificial Sequence: Synthetic polynucleotide
gaagacttagcaggtccaggatacggcccgggagccggacaacagggtcctggttcaggaggtcaacaaggcggccaaggttctggccaacaaggacctggtggtgctggacagggaggtccaaggggtcaaggaccatatggtccaggtgctgctgctgctgccgccgctgctggtggttatggccctggagctggacaacaaggaccgggttctcaaggaccaggctctggaggtcagcaaggcccaggttcccaaggcccgtacggtccatctgcagcagcagctgccgctgctgctggtcctggttatggtccaggagctggacagcaaggtcctggatctcagggtccaggatctggtggacagcagggaccaggaggtcaaggtccatatggaccatctgacgctgctgccgcagctgcagcaggtacgtcttc

SEQ ID NO: 867 - DNA, 440 bp, Artificial Sequence
  Description of Artificial Sequence: Synthetic polynucleotide
gaagacttagcaggtcctggttatggacccggtgccggacaacaaggaccgggttcaggtggccagcaaggaggtcaaggttcaggacaacaaggtcctggtggtgctggacagggaggacctagaggtcaaggaccctacggtccaggagcagcagctgcggccgctgctgctggaggatacggtccaggtgcaggacagcaaggacctggctcacagggaccaggcagtggaggacaacagggacctggctctcaaggtccgtatggtccaagtgctgccgcggcagcggctgctgccggtccaggttacggccctggtgcaggtcaacagggcccaggttcacaaggtcctggttctggtggacagcagggtccaggttctcaaggaccttatggtccatctgccgcagctgccgcagctgctgcaggtacgtcttc

SEQ ID NO: 868 - DNA, 575 bp, Artificial Sequence
  Description of Artificial Sequence: Synthetic polynucleotide
gaagacttagcaggtgcagcagccgcgtccgaggcagcagcctccgctgccgcaacatccacaaccacaacaacaagcacttccagagcggcggccgccgcctcggctgcagccgcagcttctgcatctggtgctgctggtgctgcaggagcagcctctgctgcatccgctgcttctgcaagctcctcgttgcagcaatcacttggttcagccctggcacaaagtagttcttttgctgccgcgtttgctcaagcatccagtgctgccagcgcagctgctattgcttatgccttagctcaaacggttgccaaccaaataggtttctccagttattcgtccgcatttgccagagccgcatcttccgccgtatattctattggaggtttggcttctgcgagcgcttatgcattcgcatttgcttctgcctttagtcaagtattgtctaactatggactcctcaatatcaacaatgcttatagcttggcttcatccattgcctcagctgcctcctcgtctgcttcaagcgccgctgccgctgctgccagctcgtctagtgccgctgcaggtacgtcttc

SEQ ID NO: 869 - DNA, 572 bp, Artificial Sequence
  Description of Artificial Sequence: Synthetic polynucleotide
gaagacttagcaggtgctgccgcagcttcgggaactgcagcttccgcagcagctacttcaacaactaccacaacatcaacttctagagccgcagcagcggcaagtgcggcagcagctgcttccgctagtggtgctgctgatgccgctggtgctgcatccgctgcaagcgctgcttcagcatcctcatctctccagcagtcccttggttctgctcttgcccaaagttcgtcatttgctgcagcattcgcacaagcgaattctgcagccagtgctgcagccatagcctacgctttggcacagacagttgccaatcaaattggcttttcatcatacagttctgcgttcgcgtctgccgcatctagcgctgtatctagtttgggcggattcgcttcagcttcagcttacgcttttgcatttgctagtgcattttcacaagttttgtcaaattatggcttactgaacattaataatgcctactcattggccagttccattgcatctgctgctagttcttcagcctcaagcgccgctgccgctgcttcttcatcttccgctgccgcaggtacgtcttc

SEQ ID NO: 870 - DNA, 554 bp, Artificial Sequence
  Description of Artificial Sequence: Synthetic polynucleotide
gaagacttagcaggtagtggtgctgcgagggccgctcagacagcctccgccgcttccgctgcatctgcttcgagttcacttcagcagtcacttggttccgcactcgctcaaagctcaagttttgcggctgcgtttgaccaggctaactcagccgcttcggctgctgcaatcgcttacgccctggctcaatctgctgcaaaccaagtaggactgagctcatattctgcagctatttctaatgctgcggcagctgctgtgggttccgtcggaggctacgcttctgcttcggcttatgcttttgcgtttgcatctggagtttcacaagtgttgagtaactacggattaattaatctatctaacgcattgtttttggccagtagtattgcaaatgcagcaagtgcaagtgcatcctctgccgcagccgcagctagttcttcgagcgcagctacgggcgccgctgctgcactgggtggtgccggtagtgctgcagcaacctccacgactactatcacttcgacctctacggcggtggcagcagcttcaggtacgtcttc

SEQ ID NO: 871 - DNA, 731 bp, Artificial Sequence
  Description of Artificial Sequence: Synthetic polynucleotide
gaagacttagcaggtcctggaggttacggtggaccaggacagcagggtcctggtcaaggacaacaacaaggacctgcttcagctgccgcggccgctgctgccgctggacctggaggatatggtggacctggtcagcaaggacctggacaaggtcaacagcagggtcctgcaagcgctgccgcagcggctgccgccgctgcgggtcctggtggatacggaggacctggacagcagcgtcccggacaggctcaatacggtagaggtaccggtcaacaaggtcaaggtccaggtgctcaacaaggtccagctagtgcagctgccgcagctgcagctggagctggattatacggcggaccaggtcaacaaggccctggtcaaggtcagcaacaaggacccgcatcagcagcagctgccgctgccgctgctgccgcagctggaccaggcggatatggtggtccgggtcaacagggtccaggacaagcccaacagcaaggaccagcctctgctgctgctgccgctgctgctggcccaggaggctactccggaccaggacagcaaggtcctggacaggctcaacaacagggtccagcttcagccgctgccgccgccgccgctgccgctggtccaggtggttacggtggtcctggccaacagggtccaggtcaaggccaacaacagggacctgcttccgctgctgctgctgcagccgctaccgcagcaggtacgtcttc

SEQ ID NO: 872 - DNA, 707 bp, Artificial Sequence
  Description of Artificial Sequence: Synthetic polynucleotide
gaagacttagcaggtccaggaggatacggtggtccaggtcaacagggacccggacagggtcaatatggtccaggtactggtcagcaaggacaaggaccgtctggacaacagggaccagcaggcgctgccgcagcagcagccgctgcggcaggtcctggaggttatggtggtccaggtcagcagggtccaggtcaaggacaatacggacctggtgctggacaacaaggccaaggtcctggtggccaacagggtccggcgggtgctgctgctgcagccgctgctgctgcaggacccggtggttatggaggtccaggtcaacaaggacctggccaaggacaacaacaaggtagggcaggagcagcggctgcggccgctgctggaccaggaggctacggaggtccaggacagcaaggtcctggtcaagcacagcaacaaggaccggcagcagccgctagtgctggacctggtggttacggtggtcctggtcaacaaggacccggtcaaggtcaacagaagggacctgcatcagctgcagctgcagctgctgccacagcagccggtccaggaggatatggcggtcctggtcaacagggtcctggtcaaggccagtacggccctggtaccggtcaacagggtcaaggtccaggtggtcaacaaggtcctgcatcagctgccgccgctgcagctgctgctgcaggtacgtcttc

SEQ ID NO: 873 - DNA, 755 bp, Artificial Sequence
  Description of Artificial Sequence: Synthetic polynucleotide
gaagacttagcaggtcctggtggatacggtggaccaggccagcctggaccgggacaaggtcaatatggccctggtccaggccagcagggaccaagacagggtggtcaacagggtccagctagtgccgctgccgctgccgcagccggtccaggcggctacggtggtcctggacaacagggaccacggcagggtcaacagcaaggtcctgcatccgcagctgctgccgctgctgccgcagctgcgggtcccagaggttacggtggaccgggtcagcaaggaccagtacaaggaggacaacaaggacctgcctctgccgcagctgccgcagctgctgctggtgttggaggatatggtggtccgggtcaacaaggaccaggacaaggccaatacggtcctggaactggtcaacaaggacagggaccatccggacagcagggtcctgctggtgccgccgctgcagcagctggtggtgctgctggtccaggtggttatggaggtccaggacaacaaggtccaggtcaaggacaatatggtccaggaacaggtcaacagggccaaggcccaagtggtcaacaaggtccggcaggagcagccgcggctgccgctgctgctgccggtccgggaggttatggtggcccgggacaacagggtccaggacagggacagtatggtcctggtgcaggtcagcagggtcaaggtcctggttctcagcaaggtccagcatcagcggctgcagcagcagcaggtacgtcttc

SEQ ID NO: 874 - DNA, 923 bp, Artificial Sequence
  Description of Artificial Sequence: Synthetic polynucleotide
gaagacttagcaggtcctggtggttacggaggtcctggtcaacaaggtccaggtcaaggtcagtacggacctggaacaggtcaacaaggtcagggacctggtggacagcaaggaccagttggtgccgctgctgcggccgctgctgcagtttctagcggcggatatggttcgcaaggcgccggacaaggtggacaacaaggatccggtcagggcggaccagccgctgccggacctggaggttacggaggacctggtcagcagggtcctgagcagggtcaatacggttccggtgcaggtcaacaaggacaaggtcctggtggacagcagggacctgcttctgccgccgccgccgccgcagctggcccgggtagatacggtggaccaggtcagcagggacctggacaaggtcagtatggtccaggtacgggacagcagggtcagggtccagcatccgctgctgctgctgccgcagcaggaccaggaggttatggaggtccgggtcagcaaggtcctggtcagggcagaggaacaggacagcagggtcaaggattaggaggccaacaaggtcccgattctgctgccgctgctgccgccgctgccggtccaggaggttatggtggaccaggtcaacagggtccaggacaaggacaatatggacctggtacgggacaacaaggacaaggacctggcggtcaacaaggacccgtcggagctgccgcagctgctgcagctgcagtctcctctggaggatatggatcgcaaggcgctggacaaggaggacaacagggaagcggtcagagaggaccagcagctgctggtccgggaggttactcaggccctggacaacaaggccctggtcaaggtggacagcaaggtcctgcaagtgctgcagctgcagctgccgctgcagcaggtacgtcttc

SEQ ID NO: 875 - DNA, 749 bp, Artificial Sequence
  Description of Artificial Sequence: Synthetic polynucleotide
gaagacttagcaggtccaggaggttatgtaggtagtggtcagcaaggtcctggacagggaagaggtaccggacaacagggtcaaggaactggtggtcaacaaggtcctgctagtgccgctgcttccgcagctgctggaccgggcggatatggaggccctggtcaacaaggacctggacaaggaggccagcagggtccagccacagcggccgctgccgctgctgcggcagctggtcctggaggatatggaggtcctggtcaacagggtccaggtcaaggacaatatggaccaggtacaggtcaacaaggacagggtccaggcggtcaacagggaccagcaggcgccgctgctactgccgcagctgccgcaggacctggcggctatggaggacctggccagcagggcccagaacaaggtcaatatagaccaggagctggccagcagggacagggcccaggaggacaacagggcccagctagtgccgccgctgcagctgctgctggtccgggaggctatggtggtccaggtcaacaaggtccaggacgtggtcaatacggtccaggtactggacaacaaggtcagggtccggcctcggctgctgcagctgctgcagccggtcctggtggctatggaggtcctggacagcagggaccaggtcaaggaagaggaacaggtcaacagggacagggtttgggaggtcaacaaggaccagattctgcagctgcagctgccgcagcaggtacgtcttc

SEQ ID NO: 876 - DNA, 710 bp, Artificial Sequence
  Description of Artificial Sequence: Synthetic polynucleotide
gaagacttagcaggtccaggaggatacggaggaccaggtcaacaaggtccgggtcaaggccagtatggaccaggaactggacaacaaggacaaggaccaggtggacagcagggaccagttggagctgctgcggctgcagctgcggctgtgtctagtggtggttatggttcccagggtgctggtcagggtggccaacaaggctctggacagagaggtccagctgccgctggaccaggcggttattccggtccgggtcaacagggccccggacaaggtggccaacaaggaccagcatccgccgctgctgcagctgctgccgctgcaggtcctggtggatatggtggttccggccagcagggtcctggacaaggacgaggaactggtcaacagggtcaaggtccaggcggtcaacaaggtcctgcttcggcggccgccgcagctgccgccggacctggaggatatggaggtcccggtcaacaaggcccaggtcaaggtcaatatggacctggtactggacagcagggccaaggtcccgcttctgctgctgctgcagccgccgctggacctggtggatatggcggaccaggtcagcaaggtcctggtcagggtcaatacggtccaggtactggacagcaaggccaaggtccaggtggtcagcaaggaccgggaggagcaagtgctgctgcagctgcagcagcaggtacgtcttc

SEQ ID NO: 877 - DNA, 491 bp, Artificial Sequence
  Description of Artificial Sequence: Synthetic polynucleotide
gaagacttagcaggtacaggaggagttggtggattgttcctatccagcggtgactttggacgaggtggtgctggagctggcgctggtgcggccgccgctagcgcagctgccgcatctagcgcagctgctggtgctagaggaggttccggattcggtgttggtacaggcggttttggacgtggcggagccggagcgggtactggtgctgctgctgccagtgcagccgccgcctctgctgcggctgcaggagctggtggagatggtggcctattcctgagtagtggagattttggacgtggaggagcgggcgctggcgctggagctgccgcagcctctgctgctgccgcatcatctgccgccgcaggagcacgtggtggatcaggattcggagttggaacgggcggatttggcagaggtggagcaggagatggagcttcagcagcggcggcatcggcagcagcagcttcagctgctgctgcaggtacgtcttc

SEQ ID NO: 878 - DNA, 725 bp, Artificial Sequence
  Description of Artificial Sequence: Synthetic polynucleotide
gaagacttagcaggtgctggaggtgatggcggtttattcctgagctctggtgacttcggtcgaggtggcgcaggagccggagctggtgccgctgctgctagcgcagcagccgcttcttccgctgctgctggagccaggggaggatctggcttcggagtcggtaccggaggctttggtcgtggaggagccggtgatggagcttccgccgctgcagcttccgcagccgccgcctccgccgcagcagctggagcaggaggtgattccggactatttttatctagtggcgattttggtagaggaggagcaggtgctggtgcaggtgctgcagccgcgtcggccgctgcagcatcggcggccgccgccggtactggcggagtcggtggattattcctttcaagtggagattttggaagaggtggtgcaggagctggtgctggtgctgctgcagcttcagccgctgcagcatcttcggctgccgccggagcgcgtggaggttctggattcggcgttggtaccggaggattcggtcgtggaggaccaggtgctggtactggagccgcggctgccagtgctgccgctgcttcagcagctgcggcaggcgccggaggagattctggacttttcttatcttccgaggatttcggaagaggaggagctggtgccggtacaggtgccgcagcggcatccgcagcagctgcctctgctgccgctgcaggtacgtcttc

SEQ ID NO: 879 - DNA, 752 bp, Artificial Sequence
  Description of Artificial Sequence: Synthetic polynucleotide
gaagacttagcaggttcaggtgctggtcaaggtaccggtgctggtgctggtgctgctgctgcagcagccggtgccgcaggtagtggagctggtcaaggtgctggatctggagcaggcgcggctgcagcggcggccgcggcttccgctgcaggtgcgggccaaggtgctggatcaggtagcggagctggtgcggctgcggctgctgcggccgccgctggtgctggccaaggagctggaagcggatccggagccggcgcggctgccgctgctgccgcagcagccgcagcagctcaacaacaacaacaacagcaagcagcagctgctgcagcagctgccgctgcagccgcagctggttctggtcaaggtgcctctttcggagtaacgcaacaattcggtgcaccatctggtgctgcctcctctgctgctgccgctgctgctgcagcggctgccgccgctgctggcagtggtgcaggccaagaagctggcacaggtgctggtgcagccgcggctgctgcagccgcaggagcagccggatcgggtgcaggtcaaggcgctggaagtggagccggtgctgctgctgctgcggctgcagctgcctcagctgctggcgcgggacaaggtgctggttctggttcaggagctggtgctgccgcagctgctgctgctgccgccgctgcggcacaacagcagcagcagcagcaagcggcagcagctgcagctgctgccgctgcagctgccgcaggtacgtcttc

SEQ ID NO: 880 - DNA, 590 bp, Artificial Sequence
  Description of Artificial Sequence: Synthetic polynucleotide
gaagacttagcaggtggtgctggacaatctggctcaggtccatacggtgcttcttacttgtcctctacaacctatactacttcctctcaaggagcaggaggtggcgtcggtggttacggtcaaggttcaggaactggttccgctgcagctgctgctggtgctgctggcgctggccaaggaggccaaggaggttatggacaaggtgctggacagggtggtttgggtggatacggacagggtggtggagctggtgcagcagccgcagccgcggctgcagcaggaggtgcaggttccggtcaaggaggatatggaggccaaggaggcttaggtggttacggacagggtgctggtgctggtgctgctgccgcagccgctgccggaggtgcgggagcaggtcaaggtggatttggtggacaaggtggatatggacaaggtggcggcgctggagcagcagctgccgctgcagctgcagccgctgcaggcggagcaggatccggtcaaggtggttatggcggacaaggtggtcttggaggctatggacaaggagctggtgctggagctgctgctgcagcagctgcaggtacgtcttc

SEQ ID NO: 881 - DNA, 521 bp, Artificial Sequence
  Description of Artificial Sequence: Synthetic polynucleotide
gaagacttagcaggtggtgcgggagctggtcagggctcctatggaggacaaggtggttacggacaaggaggagccggtgccgccacagctaccgctgctgcagctggtggtgccggatccggacagggaggttatggaggtcaaggaggactgggtggctatggacaaggtgccggtgctggtgctgctgcagccgcagcagctgctgctggaggagccggcgctggtcaaggtggttacggtggtcaaggtggccagggaggatacggtcagggagccggtgcaggtgcagctgcagcagccgctggcggcgctggtgcaggtcaaggaggctacggcggacagggaggatatggtcagggtggtggtgctggagctgctgcagctgctgctgctgcatctggaggatcaggatccggtcaaggaggttacggaggtcaaggtggattgggcggttacggtcagggtgctggagccggagctggagccgctgcatcagcggcagccgcaggtacgtcttc

SEQ ID NO: 882 - DNA, 479 bp, Artificial Sequence
  Description of Artificial Sequence: Synthetic polynucleotide
gaagacttagcaggtgccggatctggtcaaggtggttacggtggccagggaggactgggaggttatggacaaggtgccggtgccggcgctgcagcaggagcctcaggctcaggctctggtggcgctggtcaaggaggtttaggcggttacggccaaggtgctggtgcaggtgcggctgcagcggctgcaggagctagcggagccggccaaggaggattcggaccatatggttcctcttatcaaagtagtacatcttactcagttacttctcagggagctgctggtggactcggtggatatggtcagggttccggcgctggagccgcagctgccggtgcggcaggacaaggtggtcaaggaggatatggccaaggtgcaggagcgggtgctggagcaggtgctggacaaggtggcctgggtggatacggtcaaggtgccggttcatctgctgcatctgctgccgctgcaggtacgtcttc

SEQ ID NO: 883 - DNA, 707 bp, Artificial Sequence
  Description of Artificial Sequence: Synthetic polynucleotide
gaagacttagcaggtcaaggtggtcagggaggatatggtggtttaggtcagggaggttatggtcagggtgctggttcgtctgcagctgcagcagctgccgccgccgccgcagctgccgctgcaggtaggggtcaaggtggttacggtcaaggatccggaggaaatgctgctgcggccgccgcagctgcagcagcagcagcatctggccaaggtggacaaggtggtcaaggaggacaaggtcaaggcggttatggccaaggtgcaggatcatcagctgcagcggctgccgctgctgctgctgcggctgccgctgcgggtcagggtcaaggtcgttacggtcaaggagctggtggcaacgccgcagctgctgcagctgcagcggccgccgctgctgccggtcaaggaggccaaggaggtcaaggtggtctgggccaaggtggatatggtcagggagcgggatcttcagccgctgctgccgcagcatcagctgcagcagccgccgctggtagaggtcagggcggatatggtcaaggcgctggcggtaacgcagctgccgcagctgctgccgccgctgccgcagctgccgccggtcagggtggtcaaggaggttatggtggtctaggtcaaggcggatacggacaaggtgctggatcatcagcagctgccgctgctgcagctgctgctgccgctgctgcaggtacgtcttc

SEQ ID NO: 884 - DNA, 584 bp, Artificial Sequence
  Description of Artificial Sequence: Synthetic polynucleotide
gaagacttagcaggtggacagggtggtcagggacaaggtagatatggacagggtgccggatcctcggccgcagcagctgccgcagctgctgccgctgctgcagctgccggtcaaggacaaggtggttatggtcaaggtgctggtggtaatgcagccgcagctgctgctgccgcagctgcagccgccgctggtcaaggtggacagggcggacaaggtggattgggccaaggtggatacggtcaaggtgcaggctcgtctgcagcggcagctgccgctgctgctgcagctgctgcagctggacgtggacagggtggctacggacagggtgccggcggaaatgctgccgctgccgcagccgccgcagctgaggctgctgctgccggacaaggaggccaaggaggatatggaggattgggtcagggtggttacggacaaggtgctggtagttccgcagcagcagctgcagctgccgctgcagcagctgctgctggacgtggtcagggtggttatggacaaggtgcgggtggtaacgccgcagctgcagctgcagccgcggcagcagcagcagccgcaggtacgtcttc

SEQ ID NO: 885 - DNA, 608 bp, Artificial Sequence
  Description of Artificial Sequence: Synthetic polynucleotide
gaagacttagcaggtcaaggtggccaaggtggctacggtggcttgggtcaaggtggttacggacaaggagctggatcatcagccgctgctgctgcagctgctgctgctgcagcagccgccggcggccagggaggtcagggacagggacgttatggccaaggagccggttcatctgcagcagctgcagcggcagctgctgctgcggccgctgctgctggaagaggacaaggtggttatggtcaaggttctggcggaaatgctgctgctgccgctgcagctgctgccgctgctgcctctggtcaaggatcacaaggcggtcaaggtggacagggtcaaggcggatacggacaaggcgcgggttcttcagcagccgctgctgcggccgccgctgccgctgctgctgcctcaggaagaggtcagggtggatacggacagggagcaggaggtaatgcagccgcagccgcggccgctgctgcagcggctgcagcagctggtcaaggtggtcaaggcggatatggtggtttgggtcaaggcggttacggacagggtgctggtagttctgctgcagcagcagccgctgcagctgccgccgcagcaggtacgtcttc

SEQ ID NO: 886 - DNA, 584 bp, Artificial Sequence
  Description of Artificial Sequence: Synthetic polynucleotide
gaagacttagcaggtggacaaggtggccagggtcaaggtggttacggacagggtgctggtagttctgctgccgccgccgcagcagcagcggccgctgcagctgctgctggtagaggtcaaggaggttacggacaaggatctggaggaaacgcagcagctgctgcagctgccgctgccgccgctgcaagtggccagggaggacagggaggccaaggaggacagggacagggtggatacggtcaaggcgctggatcttcggctgctgctgcagctgcagctgctgcagccgcggcagccgctggacaaggtcaaggcggatacggacaaggtgcaggtggaaatgcagctgctgctgccgccgcagcagctgccgcagctgctggtcaaggtggacaaggtggacagggtggcttgggacaaggaggatatggtcaaggagctggtagctctgccgcagcggcagcagccgctgccgcagcagctgcagctgcaggaagaggacagggaggttatggtcaaggtgttggaggtaacgctgctgctgccgcagccgctgctgccgcggctgccgcaggtacgtcttc

SEQ ID NO: 887 - DNA, 698 bp, Artificial Sequence
  Description of Artificial Sequence: Synthetic polynucleotide
gaagacttagcaggtcaaggtggtcagggtggacagggcggattgggccaaggaggttacggacaaggagcaggatcttccgcggctgcggcagctgcggccgccgctgccgccgcagctgctggcagaggtcaaggtggttatggtcagggatcaggtggaaacgcagccgctgcagcagctgccgctgctgctgccgcatctggacaaggttctcaaggaggacagggaggtcaaggtcagggaggatacggtcaaggtgctggttcctctgccgccgcagcagctgcggctgccgccgcggcagctgcttctggtagaggtcaaggaggttatggtcaaggagctggaggtaacgcagccgccgccgccgccgctgccgcagcagctgctgctgccggtcaaggtggtcaaggaggctatggtggcttgggtcagggaggttatggccagggcgcaggtagttctgctgcggccgctgccgcagccgcagcagcagctgctggaggtcagggcggacaaggccaaggaggttatggacaaggttctggaggttctgcagcagcagctgcagccgcagcagctgccgcagctgctgctgcaggaagaggacaaggtggatatggacaaggatctggtggaaatgcagcagcagcggctgctgctgccgctgcagcagccgctgcaggtacgtcttc

SEQ ID NO: 888 - DNA, 680 bp, Artificial Sequence
  Description of Artificial Sequence: Synthetic polynucleotide
gaagacttagcaggtggacagggtggattttcaggacaaggacaaggaggatttggtcccggcgctggttctagcgctgctgcagcagccgcagcagccgctgctgcaagacaaggaggacaaggacagggcggatttggtcaaggagctggaggtaacgcagctgctgctgcagccgccgctgctgctgcagctgccgcccaacagggaggacagggtggcttttcaggtagaggtcaaggaggtttcggccctggtgctggatcgtccgctgcggctgctgcagctggacaaggtggacaaggccagggaggattcggtcaaggtgcaggtggtaacgcagctgccgccgccgccgctgcagccgctgccgccgctgcagctggtcagggaggtcaaggtagaggcggttttggtcaaggagccggtggtaatgccgcggcagcggccgcagccgccgctgccgctgctgccgccgctcaacagggtggtcaaggaggttttggaggacgaggccaaggaggattcggccctggagcaggttctagtgcggcagcagctgcagcaggacagggaggacaaggaagaggcggttttggacaaggtgcaggaggtaatgctgctgccgcttcagctgcagctgctgcttccgccgccgcagcaggtcaaggtacgtcttc

SEQ ID NO: 889 - DNA, 599 bp, Artificial Sequence
  Description of Artificial Sequence: Synthetic polynucleotide
gaagacttagcaggtggtcaaggaagaggtggttttggacaaggcgctggaggaaacgctgccgcagcagctgctgctgcagcagccgctgcggcagctcagcaggtaggccaattcggcttcggaggtagaggacaaggaggatttggacccttcgctggatcctcggcagccgctgctgctgctgcatccgctgctgcaggtcagggcggccagggtcaaggaggattcggccaaggtgccggtggtaatgcagctgcagctgctgcagcggctgcagcagcggctagacaaggaggtcaaggacagggaggattttctcaaggtgctggtggaaacgctgccgccgccgctgccgctgccgccgctgcagctgctgctgctcaacaaggtggccaaggaggatttggtggacgtggtcaaggtggttttggtccgggcgctggttcaagcgccgctgctgccgctgctgccactgctgctgctggtcagggaggtcagggtcgaggtggtttcggacaaggtgcaggttcaaacgccgccgctgcagcagctgcagctgcagcagcagcagctgctgcaggacaaggtacgtcttc

SEQ ID NO: 890 - DNA, 512 bp, Artificial Sequence
  Description of Artificial Sequence: Synthetic polynucleotide
gaagacttagcaggtcagggaggacaaggaggttacggaggtttaggccaaggaggttatggtcaaggagctggatcttctgctgccgcagctgccgctgccgcagctgcagcaggtagaggtcaaggtggttacggtcagggttccggaggaaatgccgctgcagcagccgcagcagctgctgcggcagcatccggtcagggaggtcaaggtggacaaggcggacagggccagggtggctacggacagggagccggatcatcagctgcagctgctgctgcagcagcagccgctgccgctgcagcggccggtagaggccagggtggttatggtcaaggtgctggaggaaacgctgccgcagccgctgctgctgctgccgctgctgcttcaggtcagggtggacaaggtggccagggaggacagggtcagggaggttacggtcagggcgccggctcctcagccgctgctgcggctgctgcagcagctgcagccgctgctgcaggtacgtcttc

SEQ ID NO: 891 - DNA, 560 bp, Artificial Sequence
  Description of Artificial Sequence: Synthetic polynucleotide
gaagacttagcaggtcgtggtcaaggaggttatggtcagggttccggtggtaacgctgccgcggcagctgcagctggtcagggaggctttggtggtcaagagggaaatggtcaaggcgcgggaagtgcagcagcagctgccgcggcagccgctgctgcagctggtggctctggacaaggacgttacggaggtagaggtcagggcggttatggacaaggtgcgggagccgctgcctctgctgcagctgccgctgcagccgctgccgccggacaaggaggatttggtggtcaagaaggaaacggtcaaggtgcaggttcagctgctgccgcagctgcagctgctgctgccgccgcaggtggtagcggtcagggtggatatggtggtcgtggtcaaggtggatacggtcaaggcgctggagctgccgcagcagcagctgcagccgcagctgctgcagcagctggtcagggtggacagggtggtttcggatcgcaaggtggtaatggccaaggagctggttcagctgcagcggctgctgcagccgctgctgcaggtacgtcttc

SEQ ID NO: 892 - DNA, 665 bp, Artificial Sequence
  Description of Artificial Sequence: Synthetic polynucleotide
gaagacttagcaggtggttacagacctgtttcaggacaacaaggcccaggtcagcaaggaccaggatcaggtggacaacaaggtcctggaggacaaagaccctacggaccaggtgctgctgctgcagctgccgctgcaggaggatatggtccgggaagtggacagggtggtccaggccagcagggcccaggctccggcggtcagcaaggtcctggtggccaaggaccatacggtcctggtgctgctgcggcagcagctgcagcagctggtggatatggtcccggttctggtcagggtggacaacaaggaccaggatcgcagggtccaggttctggcggtcagcaaggcccaggtggtcaaggcccatatggaccgtccgctgccgcggctgctgcagctgttggtggttacggtccaggcgctggtcaacagggtccaggtcaacaaggacctggatctggaggtcagagaggcccgggaggacaaggtccatatggaccaggcgctgctgcggccgctgccgcagctgcgggtggttatggtcctgcatcaggccaacagggccctggtcaacaaggtcctggttccggaggacaaagaggccctggtggtcaaggtccttatggaccaggtgccgccgccgctgcttccgcaggtacgtcttc

SEQ ID NO: 893 - DNA, 563 bp, Artificial Sequence
  Description of Artificial Sequence: Synthetic polynucleotide
gaagacttagcaggtgcatcaggagccggtcaaggtcaaggttatggacagcaaggtcagggaggaagtagtgctgcagccgccgctgctgctgccgccgctgcagctgcggccgctcagggacaaggccagggttatggtcagcagggtcaaggttctgctgctgcagccgctgctgctgctgcggcgggtgcctctggcgctggtcaaggtcaaggatacggtcaacagggacaaggaagtgccgcagctgcagcagccgctgccgctgccggtgcaagtggagcaggtcaaggtcagggttacggacaacaaggtcaaggtggctcctctgctgctgctgcagcagctgctgctgccgctgcagccgctgcagcagcccaaggccaaggatatggtcaacaaggacaaggatcagctgcagccgccgcagctgcagctgctggagcatctggagctggacaaggtcaaggctacggccaacagggtcaaggcggctcttctgccgctgccgcagctgctgccgcggctgccgccgccgccgccgctgcaggtacgtcttc

SEQ ID NO: 894 - DNA, 473 bp, Artificial Sequence
  Description of Artificial Sequence: Synthetic polynucleotide
gaagacttagcaggtgcttccggcgctggacaaggacagggttacggacaacaaggccaaggaggcagttctgctgctgcagctgctgcggctgccgctgcggcccaaggtcaaggacagggatacggtcagcagggtcagggctatggacagcaaggtcaaggcggttcgtctgccgcagctgcagctgccgctgctgccgctgctgcagcacagggtcagggccaaggttacggtcaacaaggacaaggatctgccgccgccgctgctgcagctgcagctggtgcttccggtgccggccaaggacaaggttacggtcagcaaggacaaggtggatccagtgctgccgctgccgctgctgctgctgctgcagcagcagccgccgcacagggtcaaggatatggacaacaaggacaaggttcagcggctgctgcagctgcggcagctgctgcagcagccgcaggtacgtcttc

SEQ ID NO: 895 - DNA, 569 bp, Artificial Sequence
  Description of Artificial Sequence: Synthetic polynucleotide
gaagacttagcaggtgaggccttttctgcatcatccgctagttctgcagttgtgtttgaatctgcaggacctggtgaggaagccggtagttccggtgatggagcttctgctgctgcttcggccgctgctgccgcaggagcaggatcaggtagacgcggaccaggtggagctagatctagaggtggtgcaggtgctggcgccggtgcaggaagtggcgttggcggttacggatctggttctggcgcaggtgctggtgccggagctggcgctggagctggcggagaaggtggattcggagaaggtcaaggatatggagcgggtgccggagctggattcggatctggagcaggcgccggtgctggagccggttctggtgcaggtgcaggagaaggcgttggttctggagcaggtgctggtgctggagctggctttggagtaggtgcgggtgctggagcaggagctggtgctggattcggtagtggtgcaggtgccggttctggcgcgggtgctggatatggtgctggtagagccggaggcagaggtcgtggtggaaggggaggtacgtcttc

SEQ ID NO: 896 - DNA, 569 bp, Artificial Sequence
  Description of Artificial Sequence: Synthetic polynucleotide
gaagacttagcaggtgaagctttctccgcttcatcggctagttcggctgttgtattcgaaagcgctggacctggtgaagaggccggttcttcaggtggaggagcttcagcggccgcatctgctgctgctgctgcaggagctggatctggtagaagaggtccgggtggagccagaagcagaggaggagctggtgctggtgcaggcgcgggatctggtgttggaggatatggatcgggcagcggagccggagctggcgctggtgccggtgccggtgccggaggtgaaggcggctttggtgagggtcaaggttacggcgctggtgcaggtgctggctttggttccggagctggagcgggagccggagcaggttccggtgcaggagctggagaaggagtaggtagcggtgcaggagcaggtgcgggtgctggctttggagtaggagccggtgccggagctggagcaggagctggttttggctcaggcgctggagctggatctggcgctggagcaggatacggtgctggccgtgctggaggaagaggacgtggaggcagaggaggtacgtcttc

SEQ ID NO: 897 - DNA, 572 bp, Artificial Sequence
  Description of Artificial Sequence: Synthetic polynucleotide
gaagacttagcaggtagttacgcatacgcgcaggctgctgcaggtgctttcgcaaacgtcttgttccaagccggagttttaacctacgcaaatgcttctgcccttgctagcgcatatgcatcagcgtatgcctcttccgtcgcatcggcagctgcgtcagcttcggcaggagcatccgcttctagcggcgcttcggcatcagcttctgctgcagccgcagctgctgcagcggccgcagctagtgcctctgccggagcctcagcatcagcaggcgcgagtgcttcagcaggtgcttcagcgagtgcctcagcatcggccacagcatccgctttcgctagtgccttcgcatctgccgtagttcaaactggatacttttctaacgtgtttggtaatgtatattcggcagctcaagccagctattatgcttctgcgtccgcacaggctgctgcctccgctgctggttttggctcatctgtcgctaacgctgtggctagcgcttccgcttccgccgctggcggagtttcagttggagctggtgctcaagcttatgcctcagctttaggtacgtcttc

SEQ ID NO: 898 - DNA, 569 bp, Artificial Sequence
  Description of Artificial Sequence: Synthetic polynucleotide
gaagacttagcaggtaatggactcggtcaagctttattggcaaacggtgtattgaatagcggaaattacctacaactggcaaattctctagcttattcctttggatcctcgctatcccaatactctagtagtgctgcgggagcttctgcagccggtgccgcatcaggagccgctggtgctggtgcaggtgctgcctcctctggaggaagttctggatctgccagtagctcgaccacaactactacaactacctccacaagtgcggcagccgccgctgctgctgccgcagccgctgcatctgcagctgcatcaacctctgccagcgcttcagcttcggcctccgcctctgcttccgccttctctcagacttttgttcaaacagttctacaatctgctgcattcggatcttatttcggtggaaatctttccctgcaatcagcccaagctgctgccagcgcagctgctcaagccgcggcacaacaaattggcttaggatcatacggttatgccctagcaaatgctgttgcatccgcttttgcctccgcgggtgcgaacgcaggtacgtcttc

SEQ ID NO: 899 - DNA, 572 bp, Artificial Sequence
  Description of Artificial Sequence: Synthetic polynucleotide
gaagacttagcaggttcctatgcttacgctcaggcggctgccggagcttttgccaacgtattgtttcaagctggtgtattgacatacgccaatgcttccgccctcgccagtgcctatgcaagtgcttatgctagctctgtagccagtgctgcagctagcgcttcagcaggagcctctgcatcttcaggagctagtgccagtgcaagtgcagcagcagctgcggccgctgcagctgctgcatcagcctcagccggtgcttcagcttcagccggcgcatctgcgtctgctggtgcgtccgcctctgccagtgccagtgctaccgcctctgctttcgcatcagcttttgccagcgctgtagtccaaactggatatttctctaatgtctttggcaacgtctactccgctgcacaggcctcctattacgcatctgcctcggcccaagctgccgctagtgctgctggattcggatctagtgtagctaacgccgttgctagtgcaagtgcttctgctgcaggaggagtatctgttggtgctggtgcacaggcttatgcttctgctctaggtacgtcttc

SEQ ID NO: 900 - DNA, 569 bp, Artificial Sequence
  Description of Artificial Sequence: Synthetic polynucleotide
gaagacttagcaggtaacggattgggacaggcattgctcgcaaacggcgtcttgaacagcggtaactaccttcaattggctaattccctggcttactcatttggatcaagtttgtctcagtactcttcatcggctgccggagcaagtgccgccggagctgcctccggtgccgctggtgctggagcgggagccgcttcatcaggaggatcttcaggttcggcttcatcatcaactactacgacaactactacatctacaagtgctgccgctgctgctgcagccgcagctgcagcagcctcagctgctgcctcgactagtgcttctgcctctgcatccgcttccgccagcgcgtctgccttcagtcaaacctttgtgcaaacggttttgcaatcagctgctttcggatcttacttcggtggtaacttgagtttgcaatctgcccaagctgctgctagcgcggccgcgcaggctgctgctcaacaaattggtttgggaagttacggctatgctctggcaaacgcagtggcttcagcttttgcgtcagctggcgctaacgcaggtacgtcttc

SEQ ID NO: 901 - DNA, 572 bp, Artificial Sequence
  Description of Artificial Sequence: Synthetic polynucleotide
gaagacttagcaggttcatacgcctacgcgcaagctgcagccggtgcttttgcaaatgttttatttcaggctggtgttctgacttacgcaaatgcatccgctttagcaagtgcttatgcatcagcctatgcttcttcagttgcgtcggcggctgcaagcgcatctgcaggagcttcggcttcaagtggagcctctgcctctgcatcagcagctgcagctgctgcagccgctgctgccgcctcggcctctgctggagcctcagcctccgccggcgccagcgcaagtgctggagccagcgctagtgcctctgcaagtgcaactgcttctgcatttgcatctgcttttgcttccgccgtggttcaaactggctatttttctaacgtctttggtaatgtgtacagtgctgcacaagcttcatattacgcctcagcctcagctcaggccgctgcaagtgctgcgggtttcggtagttccgtagccaatgccgtggcatctgcttctgcctcagcggctggaggagtttccgtcggagccggagcacaagcttacgcatcggctttaggtacgtcttc

SEQ ID NO: 902 - DNA, 569 bp, Artificial Sequence
  Description of Artificial Sequence: Synthetic polynucleotide
gaagacttagcaggtaatggactaggacaagccctattagctaatggagttctgaactcaggtaactatttgcaacttgcaaacagccttgcgtactcttttggatcctcgctgtctcaatactcaagttctgctgcaggtgcttccgcagccggagccgcttccggtgctgccggagcaggtgcaggagccgcatcatcaggtggtagctctggaagtgcttcatcctcgaccaccactactacaactacctcaacctcagctgctgcagcagcagctgcggctgccgctgctgcttcggctgcagcttctacttctgcctcagcgtctgcttctgcatcagcttcagctagcgccttctcccaaacatttgttcagactgttttacaatcggccgcatttggttcatactttggaggaaatctgtctttgcagtcggctcaagcagcagcatcagcagccgcccaagcagccgcacaacaaattggattgggttcatatggttatgctttagctaacgccgtagcatctgccttcgcctccgccggcgcaaatgcaggtacgtcttc

SEQ ID NO: 903 - DNA, 662 bp, Artificial Sequence
  Description of Artificial Sequence: Synthetic polynucleotide
gaagacttagcaggtggtgctggccaaggtggctacggcggacttggtggacaaggagctggccaaggtggttacggaggtttgggtggccagggagctggacagggagccggcgctgctgcagccgcggcagccggtggtgcaggacagggtggttacggtggtttaggttctcagggtgctggacgtggaggtcaaggagccggagctgcagctgcagctgccggaggtgctggacaaggaggctatggaggtttaggatcacaaggagccggaagaggaggccttggaggacaaggtgcaggagctgccgccgccgctgcggcaggaggtgcgggtcaaggaggttatggtggtctaggtaatcaaggtgccggaagaggcggtcaaggcgcagctgccgcagctgcaggtggtgctggtcaaggaggttacggtggactaggttctcagggcgctggtaggggaggattaggtggccaaggtgctggtgctgcagcggctgcagctggtggtgctggccagggaggatacggtggactaggaggacaaggcgctggccaaggaggctatggcggtcttggttctcaaggtgctggtcgaggaggactaggaggtcaaggtgccggagctgccgccgctgccgcagcaggtacgtcttc

SEQ ID NO: 904 - DNA, 581 bp, Artificial Sequence
  Description of Artificial Sequence: Synthetic polynucleotide
gaagacttagcaggtggtgccggacaaggtggtctgggtggacaaggtgctggtcagggagccggcgcttccgctgccgctgctggtggagctggtcaaggcggatatggtggactgggatctcaaggagccggtagaggtggtgagggagcaggtgcggcagcagctgctgcaggcggcgcaggtcaaggcggatacggaggactgggaggtcaaggtgcaggacagggaggttacggaggattgggttctcaaggtgcaggaagaggtggtttgggaggacagggtgccggcgccgccgcggcaggtggtgccggtcaaggaggtcttggaggtcagggcgctggacaaggtgccggagctgcggccgccgccgctggaggcgccggacaaggaggctatggtggtttaggttcacaaggtgctggtagaggaggattgggtggtcaaggtgctggtgctgttgccgctgcagcagccggcggtgcaggacaaggtggttatggtggtttaggatctcaaggagcaggtcgtggcggtcagggtgcaggagcagctgccgctgcggcaggtacgtcttc

SEQ ID NO: 905 - DNA, 587 bp, Artificial Sequence
  Description of Artificial Sequence: Synthetic polynucleotide
gaagacttagcaggtggtgcaggtcaaagaggttatggaggactaggtaatcaaggagctggtcgcggaggattaggaggtcaaggagctggtgctgccgccgctgctgctgctggaggtgcaggacagggtggatacggtggtcttggtaatcagggagcaggtcgaggtggacagggcgccgcggctgccgctggtggagccggacaaggtggttatggtggcttaggtagtcaaggtgctggtagaggaggtcagggagctggagctgctgccgccgcagcagtaggagctggtcaagaaggtatcagaggacaaggagctggtcagggtggttatggaggcttaggatctcagggtagcggtagaggaggattaggtggtcaaggagcaggtgctgccgctgccgctgctggtggagctggacaaggtggtttaggtggtcaaggtgcaggccagggagccggtgccgctgcggcagctgctggtggtgttagacagggaggctatggtggcttaggatcccagggtgctggccgaggtggtcagggagcaggtgctgcagcagccgctgcaggtacgtcttc

SEQ ID NO: 906 - DNA, 671 bp, Artificial Sequence
  Description of Artificial Sequence: Synthetic polynucleotide
gaagacttagcaggtcccggtggctatggacctggtcaacagggtcctggaggttatggtcccggtcaacaaggacctggaagatacggtccaggtcaacaaggaccatcaggtccaggaagtgcagccgcggctgctgctggttccggacaacagggacctggcggctacggaccacgtcaacagggtcccggtggttatggtcaaggccaacaaggtccatctggtccaggctcagctgcagcagcatctgctgcagccagcgctgagtcaggtcaacaaggtcccggtggatatggtccaggacaacaaggccctggtggatatggaccaggtcaacagggtccaggcggatacggccctggccagcaaggaccgtccggaccaggttctgcggccgctgcggctgcagctgcctcaggtcctggtcagcaaggtccaggaggctatggtcctggacagcaaggtccgggaggatatggacctggacaacaaggaccttctggacctggctctgctgcagcggctgctgccgcggcgtcgggtccaggacaacagggccctggaggatacggtccaggacagcaaggtccaggtggttatggtcctggtcagcagggactgtctggtcctggatctgctgctgctgcagcagctgcaggtacgtcttc

SEQ ID NO: 907 - DNA, 659 bp, Artificial Sequence
  Description of Artificial Sequence: Synthetic polynucleotide
gaagacttagcaggtcctggacaacaaggccctggcggatatggaccgggtcaacaaggaccatccggacctggttccgcagctgctgccgccgctgcagctgctggtcctggaggatacggtcctggtcagcaaggtcctggaggctacggaccaggacaacagggtccatccggagctggttctgcagctgctgctgcagctgcaggccctggacaacaaggattaggtggttacggaccaggacagcagggacctggtggatacggtccgggacaacaaggtccaggtggttatggacctggttctgcatctgccgctgccgccgctgctggtccaggccaacaaggacccggtggatacggccctggtcagcagggaccttccggtccaggatcggcttccgccgctgctgctgcggcggctgccggtccaggaggttatggtccaggtcagcaaggtccgggaggttatgcaccaggacaacaaggtccttccggtcctggttccgcttccgctgccgcagctgctgctgccgctggtccaggtggatacggacctggtcaacaaggacctggaggctatgctcccggtcagcaaggtccatccggtcctggatctgccgcggctgctgccgcagccgccgcaggtacgtcttc

SEQ ID NO: 908 - DNA, 647 bp, Artificial Sequence
  Description of Artificial Sequence: Synthetic polynucleotide
gaagacttagcaggtcgaggacccgaaggatatggacctaggcaacaaggtcccggagctacggctgctgctgctggacctggtggatacggcccacgacaacagggaccaggaggatatggaccaggtcagcagggaccaggtgcagcagctgccgccgctgccggtagaggaccaggtggatacggtccaggtcaacaaggaccaggtggtccaggagctgctgctgcagctgctggtagtgaaggatacggacctggtcagcaaggtcctagaggcccaggagctgctgcagctggacctggaggatacggtcctggacaacagggtgcatcagctgcagcttccgcagctgcaggaagaggacctggtggatatggacctggacagcaaggacctggaggacctagtgctgccgcagccggtcctggtggttacggtcctggtcagcaaggaccaagtgctgcagcagctgctgctgctggttctggtcctggcggttacggaccaggccagcaaggtccaggaggtcctggtgctgcagctgccgccgcgggaccaggcggatacggtccaggacaacagggtcccggtgctgcagcagcagccgccggacaagcagcggccgcggcagcaggtacgtcttc

SEQ ID NO: 909 - DNA, 698 bp, Artificial Sequence
  Description of Artificial Sequence: Synthetic polynucleotide
gaagacttagcaggtagaggaccaggaggttatggtccaggtcagcagggaccgggtggacctggagcagctgcagcggctgccggtcccggaggttatggaccaggtggttacggtccaggtcaacaaggtcctggtggtccaggagccgctgccgctgctgccgccggccgcggtccaggtggttatggtccaggacaacaaggtcctggccaacaaggcccaggtggttccggtgctgcagctgcagctgcgggaagaggtccaggtggatacggaccgggtcaacaaggccctggtggaccaggtgccgccgccgctgctgctggtccaggtggatatggtcctggtcagcagggacctggtgctgctgcagcagccgccgcagctggtagaggtcccggtggatatggtccgggccagcagggaccaggaggccctggtgccgcagctgctgctgccgctggacgtggaccgggtggatacggtcctggtcagcaaggaccaggtcaacagggtccaggcggttccggtgcagctgccgctgccgctggaagaggaccaggcggatatggtcctggacaacaaggacctggaggacctggtgccgccgcagcagctgcaggtcctggaggatatggacctggtcaacaaggaccaggagcagcagcagccgccgccgctgcaggtacgtcttc

SEQ ID NO: 910 - DNA, 698 bp, Artificial Sequence
  Description of Artificial Sequence: Synthetic polynucleotide
gaagacttagcaggtcgtggtccgggaggatacggtccaggacagcaaggtccgggtggatctggcgccgcagcagctgctgctggaagaggtccaggaggttatggtccaggacagcagggaccaggtggtccaggagcagctgcagccgctgctggtcctggtggttacggtccaggacaacaaggcacgggtgctgcggctgccgcagcagctggttctggtgccggaggttacggtcctggacagcagggcccaggtggtcctggtgctgccgcagcagcagctggacctggaggatacggccccggacagcaaggcccaggtgcagcagccgctgccgctgctggaagtggtccaggcggatatggtccaggtcaacaaggtcctggtggttcttctgctgccgccgcagccgcaggtccaggtagatacggaccgggtcagcaaggtccaggtgcagccgctgctgcttctgctggccgtggtccaggaggttacggtccgggccaacaaggtccaggcggtcctggtgccgctgctgcagctgccggtcctggaggttatggccctggtcaacaaggccctggagccgctgctgccgctgctgcaggatcaggtccaggcggatacggacctggtcagcaaggtcccggaggtccaggagctgcagctgccgcagctgcaggtacgtcttc

SEQ ID NO: 911 - DNA, 671 bp, Artificial Sequence
  Description of Artificial Sequence: Synthetic polynucleotide
gaagacttagcaggtcgtggtcctggtggctatggacaaggtcagcaaggacccggcggacctggcgcagcagctgccgcggccggtccaggtggttatggacctggacaacaaggacctggagcagcagcagctgcagccgctggatctggccctggtggatatggacctggtcagcaaggaccaggacgttcaggtgcagctgctgcagcagccgcagctggtcgtggtccaggtggatatggtccaggacagcagggcccaggaggccctggtgccgcagcggccgctgccggtcctggtggttatggtccaggccaacaaggtcctggtgcagctgcagcagctagtgctggtcgaggacctggtggatatggtcctggacaacaaggtccgggtggatccggagccgctgctgctgcagccggtagaggtcccggtggatacggtccgggtcaacaaggtccaggtggtcctggagctgctgctgcagctgccgctggccgtggtccaggtggctacggaccaggtcaacaaggccctggtcagcagggtcctggaggaagcggtgctgcggctgccgccgctggtcgtggccctggcggatacggtccaggtcaacagggaccaggtggtccaggtgctgctgctgctgccgcaggtacgtcttc

SEQ ID NO: 912 - DNA, 695 bp, Artificial Sequence
  Description of Artificial Sequence: Synthetic polynucleotide
gaagacttagcaggtcctggaggttatggtcctggtcaacaaaggccaggacaacagggccctggaggtccaggagccgctgccgctgcagcaggtcgcggtcctggaggatatggtcctggacagcaaggccctggaggtcctggtgccgctgcggcagctgcagccggaaggggacctggtggatacggacctggacaacaaggacctggtcaacaaggtccaggcggttcaggtgctgcagcagctgcagctggccgaggacccggcggatatggaccaggtcagcagggaccaggaggacctggcgccgctgccgctgctgcaggacctggaggatacggaccaggacaacaaggtcctggtgctgctgctgccgccgctgcagcaggaagaggaccgggtggatatggaccgggacaacaaggtccaggaggaccaggagcggcagcggctgcagcagctggaagaggccctggcggttatggtcccggtcagcaaggacctggtcagcagggtccaggtggtccgggtgccgctgcagcagcagccggacctggtggttatggaccgggtcaacaaggtaccggagctgctgctgctgcggctgccggttcgggagctggtggatatggaccaggacagcaaggtcctggaggccctggagcagctgcagcagctgcaggtacgtcttc

SEQ ID NO: 913 - DNA, 632 bp, Artificial Sequence
  Description of Artificial Sequence: Synthetic polynucleotide
gaagacttagcaggtccaggcggttacggtccaggacaacagggaccgggcgctgcagctgctgctgcagctggttctggtcctggtggttacggacctggccagcagggacctggcggaagcagcgctgccgctgccgctgccggacctggaagatacggtccaggtcaacaaggtccgggtgctgccgctgcagcagctgctggatcaggtccaggtggttatggtccaggtcagcaaggtccaggtggtcctggagcagctgccgctgctgccgctgccggtagaggtccaggaggatacggacctggtcaacagggacctggtggtccgggagctgctgcagccgctgctggacctggaggttatggaccaggacagcaaggacctggtgccgccgctgctgctgctgctggtagcggtccaggcggatatggtcctggtcagcaaggtccgggtggaccaggcgcagctgccgcagctgccgcgggaaggggacctggcggttacggtcaaggccagcaaggaccaggaggacctggagctgccgcagcagctgcaggtcctggtggatatggtcctggacagcagggtccaggtgctgctgctgctgcagcagcaggtacgtcttc

SEQ ID NO: 914 - DNA, 584 bp, Artificial Sequence
  Description of Artificial Sequence: Synthetic polynucleotide
gaagacttagcaggttcaggaccgggaggttatggtccaggtcaacagggacccggtcgatctggtgctgcagcagcggctgcagctgcaggcagaggtcccggtggatatggtccaggccagcaaggacctggtggtcctggtgccgcagctgctgccgcaggaccaggtggttatggacctggccaacaaggtccaggtgctgccgccgctgcttcagccggtagaggaccgggtggttacggaccaggtcagcagggacctggaggttcaggtgcagctgcagcagctgctggacgtggccctggaggttatggaccaggacagcaaggcccaggcggaccaggagcagctgctgctgccgctgctggtactggaccaggaggatatggtccaggtcagcaaggtcctggaggctccggtgctgctgccgcagcggctggtaggggtccaggtggttacggacctggacaacaaggaccaggtggtcctggagctgcagcggctgcggctggcccaggaggatatggaccaggtcaacaaggacctggcgctgctgctgctgcggcagcaggtacgtcttc

SEQ ID NO: 915 - DNA, 545 bp, Artificial Sequence
  Description of Artificial Sequence: Synthetic polynucleotide
gaagacttagcaggtagcggaccaggaggttacggaccaggccaacagggaccaggtggaccgggcgctgcagccgccgccgctggaagaggaccaggtggttatggtcctggtcagcagggaccaggtggtccaggtgcggccgctgctgctgccgcaggacgaggacctggaggatacggtcctggccagcaaggacctggtggttccggtgctgccgctgccgctagtggtaggggtccaggtggtagtggtcctggtggatacggtcccggtcaacagggaccaggagcagccgctgctgctgctgctgcaggtagaggtcctggaggttacggacctggtcagcaaggacctggaggtccaggtgctgccgctgctgccgcagccggtagaggtccgggaggatatggtcctggacaacaaggtcctggtggttctggagccgccgctgctgccgctggaagaggtcctggtggctatggtcccggtcaacaaggacctggcggacctggtgctgcagctgccgcagcaggtacgtcttc

SEQ ID NO: 916 - DNA, 491 bp, Artificial Sequence
  Description of Artificial Sequence: Synthetic polynucleotide
gaagacttagcaggtccaggaggttatggtcccggtcaacaaggtcctggagccgctgccgctgcagcaggtagaggacctggcggctatggacctggacaacagggcccaggcggttctggagctgccgcagctgccgcgggaagaggtccaggtggttatggtccaggacaacaaggacctggtggtcctggagctgccgctgcagctgcaggtcccggcggatacggaccaggacagcagggtaccggtgctgctgctgccgcggccgctggttctggtgccggtggttatggtcctggtcaacaaggaccaggaggtcctggagctgctgctgcagctgctggaccgggtggctatggaccaggccagcaaggccctggtgccgccgccgctgctgccgcaggtagtggcccaggcggttatggtccaggtcaacagggacctggtggacctggtgctgctgccgcagcagctgcaggtacgtcttc

SEQ ID NO: 917 - DNA, 548 bp, Artificial Sequence
  Description of Artificial Sequence: Synthetic polynucleotide
gaagacttagcaggtggtgccggtcaaggaggttactctggacttgatagacagagatctggcgccgctgccgctggagcatcagtggcagctcagggtggttacggtggtcttggaggccaaggagccggtgcagctggcgctgctgccgcaggtggtgctggtaggggtggatatggtggtttggttggtcaaggagctggtgctgctgctgctggtgctggagaagccggacagggaggctatggatctttgggtggacaaggtaccggtgcaggtggcgaggctgctgctgcaactggaggcgctggtcagggcggttacggtggactaggtggccaaggtgcttctgcagccggatcagccggtcaaggtggttatggtggattggccggacaaagagcaggagctgctgccactggcggtttgtttgatggatctagagatgttggtggtttctcattcgcagtttctggttcttcaggtggctaccgtagaggaggttacgttggtaatagcacagccgctgcagctgcaggtacgtcttc

SEQ ID NO: 918 - DNA, 554 bp, Artificial Sequence
  Description of Artificial Sequence: Synthetic polynucleotide
gaagacttagcaggtggtgcgggtcaaggcggttacggaggattaggaggtcaaggagccggtgctgctgctgccgctgcaggaggagccggacagggaggttacggtggtcaaggtgccggacaaggagcggctgccgctgcagcatcaggtgctggtcaaggaggctatgaaggtcctggtgcaggacaaggagctggtgctgcagctgccgcagccggtggtgccggccagggaggatatggtggtttgggcggacagggcgccggccaaggagctggtgcagccgcagccgccgctggcggtgccggacaaggtggttacggtggtcttggtggtcagggagcaggtcagggtgcaggagccgctgctgctgctgctggaggagctggtcaaggcggatatggaggtcaaggcgcaggtcaaggcgcagcagcagcagccgctggtggagccggacagggtggttacggcggcctaggttcaggacaaggaggttatggacgtcagggagctggtgccgcagccgcagcggccgctgcaggtacgtcttc

SEQ ID NO: 919 - DNA, 545 bp, Artificial Sequence
  Description of Artificial Sequence: Synthetic polynucleotide
gaagacttagcaggtggagcaggccaaggtggatacggcggtttgggcggccaaggtgctggcgccgctgctgcagctgctggtggagctggacaaggaggatacggtggtcaaggagccggtcaaggcgctgctgctgcagcagcctctggagccggacagggtggatatggcggtccgggcgccggtcagggcgcaggtgctgcagccgctgcagctggcggagctggtcagggcggttacggtggactcggtggacaaggagctggccagggagccggtgctgctgcagccgccgcaggtggagctggccaaggtggttacggaggtcaaggcgccggacaaggtgctgccgcagctgctgctggtggtgctggacaaggtggttacggtggtttaggatccggtcaaggtggatatggtggtcaaggtgccggagcagcagccgcagctggcggagccggacagggaggatatggaggtttgggtggacaaggcgctggccaaggagcaggtgcagcagccgccgctgcaggtacgtcttc

SEQ ID NO: 920 - DNA, 467 bp, Artificial Sequence
  Description of Artificial Sequence: Synthetic polynucleotide
gaagacttagcaggtggctacggtcctggtagcggtcagcaaggcccaggcgctggtcaacaaggtcctggtgcaggacagcagggaccatatggaccatctgctgcagcagcagcggctgctgctggcggttacggccctggaggagctggtcagcagggaccaggtgccggtcaacaaggacctggatcacagggtcagtccggtcctggtgccactgtcgctgctgctgctgccggaggatatggcccaggtggtgccggacagcaaggtcctggagctggacaacaaggtcagggatctcaaggaccttatggaccagcggctaccgccgctgccgctgctgctggtggttacggaccaggaagtggccagcaaggtccaggagccggtcaacaaggtccaggaggacaaggaccatatggtccatctgccgctgcagctgctgctgccgcaggtacgtcttc

SEQ ID NO: 921 - DNA, 461 bp, Artificial Sequence
  Description of Artificial Sequence: Synthetic polynucleotide
gaagacttagcaggtggatatggtcctggtagtggacaacaaggacctggagccggtcctcaaggaccaggttctcagggtccgtatggtcctggagcagccgctgccgctgcagctgtgggtggctacggtcctggatctggtcaacagggaccaggtgcaggtcaacaaggtccaggcggacaaggcccatacggaccaagttctgcagcggccgctgctgcagccggtggatacggtccaggaggagcaggtcagcaagtaccaggtgccggccaacagggtccaggaaatcagggtccatcaggacctggagctgcagcagctgctgctgctgccggaggttacggccctggaggtgctggtcaacagggcccagctgcaggccaacagggacctggctcacaaggatcgtatggaccgggtgctgcagccgctgcagctgctgcaggtacgtcttc

SEQ ID NO: 922 - DNA, 602 bp, Artificial Sequence
  Description of Artificial Sequence: Synthetic polynucleotide
gaagacttagcaggtggtcttggaggtcagggaggtctgggtggactaggtagtcaaggagctggtttgggcggctatggtcaaggtggtgctggccaaggaggagctgcagcagctgctgctgccgccggtggtttaggaggacaaggaggtagaggaggtttaggctcccaaggtgcaggccaaggaggttatggtcagggaggagctggccaaggaggtgctgctgccgcagctgcagcggccggtggactaggaggtcaaggtggactgggagcccttggaagccagggtgccggccaaggtggcgctggtcagggtggttacggacaaggaggcgcagccgcagctgctgctggaggcctcggaggtcagggtggtctaggaggattgggttctcagggagccggacaaggtggatatggccaaggtggcgccggtcaaggaggagctgccgctgctgcagcagcagctggtggtttaggtggtcaaggcggtctgggcggtttaggttcccaaggagccggtccgggaggttatggacaaggtggtgcaggtcaaggtggagcagctgccgccgctgccgcggcaggtacgtcttc

SEQ ID NO: 923 - DNA, 521 bp, Artificial Sequence
  Description of Artificial Sequence: Synthetic polynucleotide
gaagacttagcaggtggtttgggcggtcaaggtggtttaggcgctcttggcagtcaaggtgctggtcaaggcggctatggacagggtggagctggccaaggtggtgctgcagccgcagctgccgctggtggactaggtggtcaaggcggacttggtgctttaggtagtcaaggtgccggacaaggtggttacggccaaggaggttcacaaggtgccggccagggtggttatggacaaggtggcgctgctgcagccgccgctgctgcaggtggcctcggtggtcaaggtggacttggtggactaggaagtcagggagccggacaaggaggttacggacagggtggtagccagggtgctggacaaggaggtgcagctgctgctgctgctgcagctggtggtctgggaggtcagggaggcttcggtggtcttggatctcagggcgccggacagggtggctatggacaaggtggagcaggacaaggtggtgctgctgccgccgctgcggcagcaggtacgtcttc

SEQ ID NO: 924 - DNA, 746 bp, Artificial Sequence
  Description of Artificial Sequence: Synthetic polynucleotide
gaagacttagcaggtgcaggagctggtcagggcggacgaggcggctacggtcaaggaggatttggaggacaaggctccggtgcaggtgctggtgcaagcgcagctgcaggtgcaggagctggccaaggtggaagaggaggttacggacagggtggtttcggtggtcaaggttccggtgccggagctggagcttccgctgcagctggagctggtgctggtcaaggaggtagaggaggctacggacaaggcggttttggcggacaaggttcaggtgccggtgctggcgctagcgccgcagctgctgccggtgcaggacaaggtggaagaggcggttacggtcaaggtggacttggtggttcaggatctggtgctggagccggtgctggtgctgctgccgccgcagctgctggcgcaggaggttatggacaaggtggattaggtggttacggccaaggcgccggcgctggacagggcggcctcggaggttacggatcaggagcaggagccggtgcctcagccgctgcggctgcaggtgccggaggtgctggacaaggaggtttgggtggttatggtcagggcgcaggtgccggtcaaggtggtctgggtggttatggcagcggtgctggtgcaggagcagcagccgctgccgcagccggagccggaggctctggtcaaggaggactcggtggttatggctctggaggtggagctggaggagcaagtgccgctgctgcaggtacgtcttc

SEQ ID NO: 925 - DNA, 521 bp, Artificial Sequence
  Description of Artificial Sequence: Synthetic polynucleotide
gaagacttagcaggtgcgtctgattcagcagcagctgcagctttatctgctgctagcgcaagtgcagcatctgccgcgacagctgttagtactacaacatcaacttccacgtcagcagctactgccgccgcagctgccgcttctgctgcaggcgctgctggcgcaggagctgccgccggtgcaactgcctcaagctccttcggccaaaatttgctttccggcttgctgagatccgacgccgtcgtctccgccctttcacaggcttattctgcatcaactgcatccgccctagcatcatcttacgctcaatcaggagctgatcgtgctggattcggcaattatggatctgtgattgctagcgccgcggctagcgctgttgcttctgcaggaaacaacgctggtgcctatgcctatgcaagagcctatgcatcagctatctcacaatctctttcaagccttggaattcttaattcaggtaatgcaattgctttggccaacgctttcagttcaggtacgtcttc

SEQ ID NO: 926 - DNA, 521 bp, Artificial Sequence
  Description of Artificial Sequence: Synthetic polynucleotide
gaagacttagcaggtgcttctgattcggctgcggctgctgctgtttctgccgcttctgcttctgcggcatccgcagccactgcgagtagtaggacgacgagtacttcaacttcagctgctactgcagctgctgccgctgctagtgctgcaggctcagcaggtgcgggagcagctgcaggagctaccgccagtagttccttcggtcaaaatttgctgtctggactgctccgtagtgacgcagtggtgagtgcactatcacaagcctattcggcttctactgcaagcgcactagcttcctcttacgctcaatccggtgccgatcgtgccggtttaggtaattatggaagtgtgattgcctctgccgcagccagtgccgttgcgtcagctggtaataacgctggagcgtatgcttacgctcgcgcatacgcctcggctatatctcaaagtttgagctcgctgcgaattctaaactctggaaacgccattgccctagcaaatgcattctcatcaggtacgtcttc

SEQ ID NO: 927 - DNA, 521 bp, Artificial Sequence
  Description of Artificial Sequence: Synthetic polynucleotide
gaagacttagcaggtgcttcagactcggctgcagctgctgctttgagtgctgcctcggcaagtgcagctagcgctgctactgctgcttctactactactagcacatcgacttctgcggcaacagctgcagcagcagctgcatcagccgccggagctgctggtgcgggtgcagcggctggtgctacagccagttcttcatttggacaaaacctactcagtggattgttaagatcggacgccgtcgtgtccgctctttcccaggcatattcggcaagtacagcttctgccctcgcatcatcctatgctcagagtggtgctgatagagcaggcctaggtaactacggatcagtgatcgctagtgctgctgcctctgctgttgcttctgctggtaataatgctggtgcttacgcgtatgctagagcttatgcatccgccatcagccagtcattgtcatcactcggtattctaaactctggaaatgctatcgcactagctaacgcttttacttcaggtacgtcttc

SEQ ID NO: 928 - DNA, 545 bp, Artificial Sequence
  Description of Artificial Sequence: Synthetic polynucleotide
gaagacttagcaggtggattgggtggtggacagggtgcaggtcaaggtggacagcaaggcgctggacaaggtggctatggtagcggactgggtggtgccggccaaggagctggacaaggagctagtgcagctgctgccgctgctgccggtggtctaggtggaggtcagggtgcaggccaaggtggtcaacaaggtgctggacagggaggttatggatctggactcggaggtgctggtcaaggcgcttcagccgctgcagctgccgccgcagccggtggattaggtggaggccagggtgccggacaaggaggacaacaaggagcaggacagggaggatacggttcaggtctaggtggagctggacaaggtgcttcagctgctgcagctgctgctgcagctggtggtttgggtggaggtcagggagcaggccaaggaggccagcaaggtgctggtcagggtggttacggatcaggtttgggaggcgctggtcaaggagcaggtcaaggtgctagtgcggccgctgctgctgccgcaggtacgtcttc

SEQ ID NO: 929 - DNA, 554 bp, Artificial Sequence
  Description of Artificial Sequence: Synthetic polynucleotide
gaagacttagcaggtggttctggaggtcaaggaggacagggcggttatggatccggaggtcaaggtcagggacaaggtggttatggaagcggagccgctgcagccgcagctgccgcagctggaggatcaggtggtcaaggtggtcagggaggttacggatctggcggacagggtcaaggtcagggtggttacggcgcaggtgctgcagcagcggctgcagccgccgcaggtggttccggtggtcaaggcggagccggtgctggtggccaaggcggacaaggtcaaggacagggtggttatggttctggagccgctgctgccgctgcagccgctgctggtggactcggaggacaaggtggatacggttctggtagacaaggtcagggtcaaggtggttacggctcaggtgcggccgccgctgcagctgcggctgctggtggcagcggaggtcagggtgcccaaggtggatacggatccggtggtcaaggacaaggtcagggaggatatggttccggtgccgctgctgctgccgccgctgccgcaggtacgtcttc

SEQ ID NO: 930 - DNA, 614 bp, Artificial Sequence
  Description of Artificial Sequence: Synthetic polynucleotide
cgcgccttagcgatggtctcaaggtggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggaccaggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgcaggtacgtcttcatcgctatcctgca

SEQ ID NO: 931 - DNA, 425 bp, Artificial Sequence
  Description of Artificial Sequence: Synthetic polynucleotide
cgcgccttagcgatggtctcaaggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaaggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgcaggtacgtcttcatcgctatcctgca

SEQ ID NO: 932 - protein, 147 aa, Aliatypus gulosus
GAASASGAASASGAASASEAASSSSTTITTKGTSASGLLSSPYGSVSISVENRIISLISSILSEFISIESAFNYSSFAKKLAFLASEISVSNPGLSASEVISEVLLETVTALIHILASSQVGSVSTADLSSVSRAFAQSFAQAFAHQ

SEQ ID NO: 933 - protein, 180 aa, Aptostichus sp.
GAAATSSSTTAASSAGSSSSVSSISAGVSSDAGGAYLSGDVSEFGSSGSLPQAVLPLSQWPGTGSSGADLLISDLLSLRDGLLSSSASERISAIILPLVSALSPTGVNFSEIGNIILSLISKISGSCVGLSPSQTFSEALLEVIIALMQILSSAKVTTVSTSASGTARSLAQSLSSAMAG

SEQ ID NO: 934 - protein, 170 aa, Aptostichus sp.
GASSTTTTTEATGSDASARRISSGASSETAASSVVDSSVFSGDVSDYSGFNVLPLVSDLLSSSSGLSSPAAIRRIDSLIPLLFSSASSNNLSASFLSNVLATSVSQISEGSSGLSATQIIIEALFELISGLMHILTSAHFDAVSRATSSATASALANSLSTAFSGVNNIA

SEQ ID NO: 935 - protein, 152 aa, Araneus diadematus
GAGARAAGGYGGGYGAGAGAGAGAAASAGASGGYGGGYGGGAGAGAVAGASAGSYGGAVNRLSSAGAASRVSSNVAAIASAGAAALPNVISNIYSGVLSSGVSSSEALIQALLEVISALIHVLGSASIGNVSSVGVNSALNAVQNAVGAYAG

SEQ ID NO: 936 - protein, 145 aa, Araneus diadematus
GGQGGQGGYGGLGPQGAGGAGQGGYGGGSLQYGGQGQAQAAAASAAASRLSSPSAAARVSSAVSLVSNGGPTSPAALSSSISNVVSQISASNPGLSGCDILVQALLEIISALVHILGSANIGPVNSSSAGQSASIVGQSVYRALS

SEQ ID NO: 937 - protein, 154 aa, Araneus diadematus
GGYGPGSGQQGPGQQGPGQQGPGGQGPYGPGAASAAVSVGGYGPQSSSVPVASAVASRLSSPAASSRVSSAVSSLVSSGPTKHAALSNTISSVVSQVSASNPGLSGCDVLVQALLEVVSALVSILGSSSIGQINYGASAQYTQMVGQSVAQALA

SEQ ID NO: 938 - protein, 134 aa, Araneus diadematus
GSGPGGYGPGSQGPSGPGYQGPSGPGAYGPSPSASASVAASVYLRLQPRLEVSSAVSSLVSSGPTNGAAVSGALNSLVSQISASNPGLSGCDALVQALLELVSALVAILSSASIGQVNVSSVSQSTQMISQALS

SEQ ID NO: 939 - protein, 201 aa, Atypoides riversi
GSATSSTTTTTTVSKSAAAAAAAAAAASSASSASRDSDRSSSAAKAYASSSANASSNFENYQTSDLSRPYATSSNAPASTSGIKNDLSPLISGLISSSSGLGSSDASDRISYLLTSLLSVINSEGGRIDFAAVANILVSLVSEIRAKNSELSYFHILIEALFEVLSAVLQIISSSHIVIGNASFSSSSNLAFADACAKAFS

SEQ ID NO: 940 - protein, 187 aa, Bothriocyrtum californicum
GSAEASSVARLSSASNDVYGPTAEEFGASGSALGVSQYGEFGGLDEVSGPALQSTSPPFLPLTSDIGRFSPEISRLLSSPSGLTSEAAKERISSIIASLLSAKSSQDFNALLLSNILPSLISKISQRASGLSPTEMVTEALLEVLAGCMEILSSFNVGAQSISSSRTSSNALVQSISNQFSGLNAAA

SEQ ID NO: 941 - protein, 172 aa, Bothriocyrtum californicum
GASSAESRTSAAQSGTSGSALGVSLYGGSGSFYQGTAPELLSTSPASSPVVSDIGPELSSLLSAPTGLTSEAAKERIASIIPSLLSAISPNEFDAVLLSDSLASLISQISQSGSGLSTSQIAMEALLEVLAGCMEILSSSNVGAASVSSSRASSNALVQSISNAFSGLNAAA

SEQ ID NO: 942 - protein, 179 aa, Bothriocyrtum californicum
GRAVASGAAGSGASSAARSGASGSASGVAKYGGYGGSSDLSGPAFPKISPVSLPHIPDGRPFLPVTSDLLSSPADLTSPAANQRITSIIPILRSGISPKGFDASLLADSLSSLISEISQSASELSASDVLTEALLELVSAFLQILSSDAGSVGISSSTAFSNALAQSVSNAFYGLNTVA

SEQ ID NO: 943 - protein, 152 aa, Deinopis spinosa
GAGVGAGVGAGAGAGFGAGVGAGVGAGYGAGLGAGSGVGYGSGSSIVSTSGGDFSTTLSSASSVLASPQSVTRVSALVPNLISGGSFNSNAVSAVLPGLTSQIKAATGSNGCDSFVIALLEIVSALGHLLNNSMINVNAASVPVSPPQWLYS

SEQ ID NO: 944 - protein, 177 aa, Deinopis spinosa
GAGVGAGAGAGAGAGVGAGFGAGVGAGVGAGAGAGVGAGVGAGAGAGFGAGVGAGVGAGVGAGYGAGLGSGVGASFGGDFRTTLSSASSVLASPQSLTRVNTLVPSLISGGSFNSNAVSRALSDLNSQNRAAGSTGCDSTIQTLFEMVSAMDHILKNSIISDTAASVPVSPPQWLYS

SEQ ID NO: 945 - protein, 162 aa, Deinopis spinosa
GASSSAAAAAATGGGGAGGYGPGIGGGYGPASPTGTGSGLGSGAGAVSPASGTGLGGYGGGSLESSISGLSSQASATRVSSLSSSLTSGGTLNLAALPNQLQQSASEISVSSPGASSCGTMVQLLLELSYSLIYALSSAYGTDASYVNEAMNNIFHILNAFP

SEQ ID NO: 946 - protein, 136 aa, Artificial Sequence
  Description of Artificial Sequence: Synthetic polypeptide
GAGGAGGGQGGYGGQGGYGQGTGAGGASSAGLSVTVGNMVSRLSSPEAASRVSSAVSSLVSNGQVNVDALPSIISNLSSSISASATTASDCEVLVQVLLEVVSALVQIVCSANVGYINPEASGSLNAVGSALAAMG

SEQ ID NO: 947 - protein, 239 aa, Euagrus chisoseus
GAYAYAYAIANAFASILANTGLLSVSSAASVASSVASAIATSVSSSSAAAAASASAAAAASAGASAASSASASSSASAAAGAGAGAGAGASGASGAAGGSGGFGLSSGFGAGIGGLGGYPSGALGGLGIPSGLLSSGLLSPAANQRIASLIPLILSAISPNGVNFGVIGSNIASLASQISQSGGGIAASQAFTQALLELVAAFIQVLSSAQIGAVSSSSASAGATANAFAQSLSSAFAG

SEQ ID NO: 948 - protein, 146 aa, Plectreurys tristis
GAGAGAGSGAGAGAGAGAGSGASTSVSTSSSSAAGAGAGAGSGAGAGSGTGAGIALPSIVLSPAASSRISSVSSSVQSAGSGLSFSSLSNTLSQTASAIRSSNPQLSSSDVLIQSLVEIIVGLVQAFTGSSASAQTFVNSLSQVAG

SEQ ID NO: 949 - protein, 184 aa, Artificial Sequence
  Description of Artificial Sequence: Synthetic polypeptide
GQGTDSSASSVSTSTSVSSSATGPGSRYPVMDYGADQAEAAASAAAAAAAEAATIAGLDYEGQGQGTDSGASSVSSSTSVSSSATGVTQTTIALPPDVSARISFLTSYLQSAGSGLSLYTLSNLLSQTALAISKSRPELSPNEVLIQSLAEIIVALVQALTKQASSSASVQYFGRFNSLSQVAG

SEQ ID NO: 950 - protein, 132 aa, Plectreurys tristis
GTVAESGSTAASSSYAAAAAASSSAGSTSSPSFLSADSLSSSLASLRICSFSSKLMSSLYSGDGLDIAEFSDAVSSMVSSIKSSNPGVSASQILTELLFEVIVAFVQALTKSKFSTMETAESLIAAFAQAFV

SEQ ID NO: 951 - protein, 193 aa, Plectreurys tristis
GPKEEPLGESSVIATSVSAASSVSSGGAPGVQGGGPVTVSYREGPSQIPSQQTLLQAVPSTQSVGSGVPVGPNQYEMVYAPLQQFGGVSASNLLSPSAHSRIASLMSDVLSLFSPGNSGFNYGGFARALSSVARAVSQSNAKLSTTDVIIQVLMEALVALIELLSGAKIGVVHPVRAQAGASAFAQHFGSAFG

SEQ ID NO: 952 - protein, 236 aa, Agelenopsis aperta
GSLGYQLALQRANSLGIPNAASVAGAVAEAVSAVGVGASSYAYASAISNAVGPLLISQGLLSQSNASALASSFASAFAASAVSSSSSSGSTSQTLGSYLLGTRPALSSRLGLLNLPSSVAVTRPAFVSLISPVLSSETGLSSASASSRVNSLASSVASAIASGQALSADSFAKSLLIQASQIQSSAPSFKADDVVHESLLEGISALIQVINSSYGSPLSLSNAQTVNAGLVNYFLV

SEQ ID NO: 953 - protein, 205 aa, Araneus gemmoides
GNVGYQLGLKVANSLGLGNAQALASQGILNAANAGSLASSFASALSASAGSVGNRSSAGPSAVGLGGVSAVPGFISATPVVGGPVTVNGQVLPAALQTALAPVVTSSGLASSAASARVSSLAQSIASAISSSGGTLSVPIFLNLLSSAGAQATASSSLSSSQVTSQVLLEGIAALLQVINGAQIRSVNLANVPNVQQALVSALSG

SEQ ID NO: 954 - protein, 238 aa, Argiope argentata
GNVAYQLGFNVANTLGLGNAAGLGAALSQAVSSVGVGASSATYANAVSNAVGQFLAGQGILNAANAASLATSFANAVSSSALAAVSRISSPSYGAFASVPKFVPSNLNAGGVSFGEPFAALSQSVPTDLQSALAPIASSSGLGSSAASARVSSLANSVASAISSSGGSLSVPTFLNFLSSVGAQVSSSSSLNSSEVTNEVLLEAIAALLQVLNGAQITSVNLRNVPNAQQALVQALSG

SEQ ID NO: 955 - protein, 170 aa, Argiope aurantia
GSLASSFANALSNSALSVGSRVSSPSYGALSPIAAGPNFISTGLNVGGPFTTLSQSLPTSLQTALAPIVSSSGLGSSAATARVRSLANSIASAISSSGGSLSVPAFLNLLSSVGAQVSSSSSLNSSEVTNEVLLEAIAALLQVINGGSITSVDLRNVPNAQQDLVNALSG

SEQ ID NO: 956 - protein, 241 aa, Argiope bruennichi
GNVGYQLGFNVANTLGIGNAPGLGNALSQAVSSVGVGASSSAYANAVSNAVGQFLAGQGVLNAGNAGSLASSFANALSNSALSVGSRVSSPSYGALSPIAAGPNFISTGLNVGGASVGGPFDSLSQSLPTSLQTALAPIVSSSGLGSSAATARVSSLANSFASAISSSGGSLSVPTFLNLLSSVGAQVSSSSSLSSLEVTNEVLLEAIAALLQVINGGSITSVDLRYVPNAQQDLVNALSG

SEQ ID NO: 957 - protein, 179 aa, Argiope bruennichi
GSLASSFASALSNSALSIGSRVSSPSYGVFSPIAAGPNSISTGLNVGGASIGGPFATLSQSLPTSLQTALAPIVSSSGLGSSAATARVSSLANSIASAISSSGGSLSVPTFLNLLSSIGAQVSSSSSLSSSSEVTTQVLLEAIAALLQVINGAQITSVNFSNVSNVNRALVDSLVGSFA

SEQ ID NO: 958 - protein, 201 aa, Atypoides riversi; identical to SEQ ID NO: 939

SEQ ID NO: 959 - protein, 269 aa, Avicularia juruensis
GSFASASAYAFAFASAFSQVLSNYGLLNINNAYSLASSIANAASTSASSAAAAAVVASSSSAATAAGAASTSVPATSLSSATRVGGSLSSAVSPASARTATGDGTTYLPVQIQPGIGFVPSLSGDIGPNVPGSGGFGSPALPSPVYGPAILGPGLVAPALANLLPPLSVLPSDSANERISSVVSSLLSAISSNGLDASSLGGTIASLVSQISVSNAKLSSSQVFLEALLEVLSGMVQILSYAEVGAVNTDTVISTSSAVAQAISSAVSG

SEQ ID NO: 960 - protein, 220 aa, Deinopis spinosa
GASASAYASAFGSAIGQYLAGIGIISQSNASALASSFASAISSAAGSLSLGGPFGVSGLGIGGLPVGVSPVGVVGPAGVYGPAGLYGPGVVGSLGPVTPLNVIYPSLTTSIAPIIVGPAGLSSAAATSRASSLASSVASAISSAGSAGGVDVGLFASGLSSLVSQIQSSNLGLQPDQVLLEALLEGYSALAQVLISSQISSVSVSSSSALGPALLNYLVG

SEQ ID NO: 961 - protein, 179 aa, Latrodectus hesperus
GILTQENASSLASSVANALSASSLLVPSAISTGVPGLIVGPSIVSSLNAPIAGFAVPGVAQVIVPTAYSTLLAPVLSPAGLASTAATSRINDIAQSLSSTLSSGSQLAPDNVLPGLIQLSSSIQSGNPDLDPAGVLIESLLEYTSALLALLQNAQITTYDAATLPAFNTALVNYLVPLV

SEQ ID NO: 962 - protein, 189 aa, Nephila antipodiana
GVLNAVNASSLGSALANALSDSAANSAVSGNYLGVSQNFGRIAPVTGGTAGISVGVPGYLRTPSSTILAPSNAQIISLGLQTTLAPVLSSSGLSSASASARVSSLAQSLASALSTSRGTLSLSTFLNLLSSISSEIRASTSLDGTQATVEVLLEALAALLQVINGAQITDVNVSSVPSVNAALVSALVA

SEQ ID NO: 963 - protein, 232 aa, Nephila clavata
GIASDTALAGALAQAVAGVGAGASASTYANVIARAAGQFLATQGVLNAGNASALGSALANALSDSAANSAVSGNYVGASQNFGRIAPVTGGTAGISVGVPGFLRTPASTILVPSNAQIISPSLQTTLAPVLSSSGLSSASASARVGSLAQSLASALSTSRGTLSLSTFLNLLSPISSEIRANTSLDGTQATVEALLEALAALLQVINGAQITDVNVSSVPSVNAALASALVA

SEQ ID NO: 964 - protein, 210 aa, Nephila clavipes
GATAASYGNALSTAAGQFFAAQGLLNAGNVSSLASALANALSYSAANSAASGNYIGVSQNFGSIAPVAGTAGISVGVPGLLPTSAGTVLAPANAQIIAPGLQTTLAPVFSSSGLSSASANARVSSLAQSFASALSASRGTLSVSTFLTLLSPISSQIRANTSLDGTQATVQVLLEALAALLQVINAAQITEVNVSNVSSANAALVSALAG

SEQ ID NO: 965 - protein, 194 aa, Nephilengys cruentata
GQFLANQGILNTGNASSLASSFSNALSSSAANSVGSGLLLGPSQYVGSIAPSIGGAAGISIAGPGILSYLPPVSPLNAQIISSGLLASLAPVLSSSGLASSSATSRVGSLAQSLASALQSSGGTLDVSTFLNLLSPISTQIQANTSLNASQAIVQVLLEAVAALLQIINGAQITSVNFGSVSSVNTALATALAG

SEQ ID NO: 966 - protein, 317 aa, Uloborus diversus
GSQSASQAAASSSASASASASAFAQSASLALASSSSFASAISSVSSVSSLGSLGYQVGLQAAGSLGISNSQAFASSISQALTSVGVGASSAAYASAVSGVVAQYLSGTGVLSSANAQALASSFANVFAASAASASAATSASSSASAQSAAAALTQNQSAASAFSQAASQAGSQASSQAGSQVASQSASGLGAFGFGTSASGIITSSPSLANLVSNVAPILLSSNGLSSSSASSRINSIASGLSTALSSSRGVSLENLSSSLSSVFSEIQNNSFGVSAEQALIQALFEVLTGTVQVLNRGQTSFVSVSSPTVISSSFS

SEQ ID NO: 967 - protein, 219 aa, Araneus ventricosus
GAAATAGAGASVAGGYGGGAGAAAGAGAGGYGGGYGAVAGSGAGAAAAASSGAGGAAGYGRGYGAGSGAGAGAGTVAAYGGAGGVATSSSSATASGSRIVTSGGYGYGTSAAAGAGVAAGSYAGAVNRLSSAEAASRVSSNIAAIASGGASALPSVISNIYSGVVASGVSSNEALIQALLELLSALVHVLSSASIGNVSSVGVDSTLNVVQDSVGQYVG

SEQ ID NO: 968 - protein, 163 aa, Argiope argentata
GAYGGGYGGGAAVGRGITYGSASSSATSSSTATSSGSTALTSAGYGSGVGVSAGAGAGAASAGGSYSGSVSRLSSAEAVSRVSSNIGAIASGGASALPGVISNIFSGVSASAGSYEEAVIQSLLEVLSALLHILSNSSIGYVGADGLTDSLAVVQQAMGPVVG

SEQ ID NO: 969 - protein, 132 aa, Deinopis spinosa
GAGSGSQGVGSGSNYGQFSSQDVSGAVLASTSRLASGQATDRVKDVVSTLVSNGINGDALSNAISNVMTQVNAAVPGLSFCERLIQVLLEIVAALVHILSSSNVGSIDYGSTSRTAIGVSNALASAVAGAFS

SEQ ID NO: 970 - protein, 180 aa, Latrodectus hesperus
GSGSASVSTGGYGQSQVARASSSSAVGTSSSVSTSGSSGYSQVSGGYGQSSAVGQASAGYGQMQSGVAVSGGSASATISSAASRLSSPSSSSRISSAASSLATGGVLNSAALPSVVSNIMSQVSASSPGMSSSEVVIQALLELVSSLIHILSSANIGQVDFNSVGNTAAVVGQSLGAALG

SEQ ID NO: 971 - protein, 146 aa, Metepeira grandiosa
GYGSSSSVSSSSSAASSSTSGVVTSGGYGYGAGAAAGAGAGAGASAGSYSGAVNRLSSAEAASRVSSNVAALASGGPAALANVMGNIYSGVASSGVSSGEALVQALLEVISALVHLLSNASIGNVSSAGLGNTMSLVQSTVGAYAG

SEQ ID NO: 972 - protein, 150 aa, Nephila antipodiana
GAGAGATGGYGRGAGAGATNAGGYGGQGGYGAGARAFAGAGVGVGTTVASTTSRLSTAEASSRISTAASTLVSGGYLNTAALPSVIADLFAQVGASSPGVSDSEVLIQVLLEIVSSLIHILSSSSVGQVDFSSVGSSAAAVGQSMQVVMG

SEQ ID NO: 973 - protein, 160 aa, Nephila clavipes
GAGAGRGGYGRGAGAGGYGGQGGYGAGAGAGAAAAAGAGAGGYGDKEIACWSRCRYTVASTTSRLSSAEASSRISSAASTLVSGGYLNTAALPSVISDLFAQVGASSPGVSDSEVLIQVLLEIVSSLIHILSSSSVGQVDFSSVGSSAAAVGQSMQVVMG

SEQ ID NO: 974 - protein, 208 aa, Nephilengys cruentata
GAGAGGTGGYGRGSGAGAAAGAAAGAGAAGGYGGYGAGAGAGAGGARGYGGGAGAGAGAAAGGYGRRAGGSIVGTGISAISSGTGSSYSVSSGGYASAGVGVGSTVASTTSRLSSAQASSRISAAASTLISGGYLNTSALPSVISDLFAQVSASSPGVSDSEVLIQVLLEIVSSLIHILSSSSVGQVDFNSVGSSAAAVGQSMQVVMG

SEQ ID NO: 975 - protein, 217 aa, Parawixia bistriata
GAGAGGGYGGGYSAGGGAGAGSGAAAGAGAGRGGAGGYSAGAGTGAGAAAGAGTAGGYSGGYGAGASSSAGSSFISSSSMSSSQATGYSSSSGYGGGAASAAAGAGAAAGGYGGGYGAGAGAGAAAASGATGRVANSLGAMASGGINALPGVFSNIFSQVSAASGGASGGAVLVQALTEVIALLLHILSSASIGNVSSQGLEGSMAIAQQAIGAYAG

SEQ ID NO: 976 - protein, 188 aa, Uloborus diversus
GAASSQVVSRTTTTTSQSAAGGAASGYSTGVGSGAAAATSGAGYGGQRGYGTGAGAAAGAAASGTGAGYGGQAGYGQGAGASAAAAASAASNRIVSAPAVNRMSAASSTLVSNGAFNVGALGSTISDMAAQIQAGSQGLSSAEATVQALLEVISVLTHMLSSANIGYVDFSRVGDSASAVSQSMAYAG

SEQ ID NO: 977 - protein, 165 aa, Araneus ventricosus
GGPGGPGGPRGAYVPGAGGFSGVSSGAGGVRGGSVMPSGGSGSAGPVTIVENITVGGGPSGGSGGAAGGQTYQTYGGSSRLPSLVNGLMGSMQPTGFNYQNFGNVLSQYATGSGTCNSNDVNLLMDALMAALHCLSYGSGSVPSTPTYSAMSAYNQSIRRMFTYS

SEQ ID NO: 978 - protein, 216 aa, Argiope trifasciata
GGAGGPGAGGVGPGGVGPGGVGPGGIYGPGGAGGLYGPGAGGAFGSGGGAGAPGGPGGPGGPGGPGGLGGGVGGAGTGGGVGPGVGGVGPSGGAGGTGPVSVSSTITVGGGQSSGGVLPSTSYAPTTSGYERLPNLINGIKSSMQGGGFNYQNFGNILSQYATGSGTCNYYDINLLMDALLAALHTLNYQGASYVPSYPSPSEMLSYTENVRRYFS

SEQ ID NO: 979 - protein, 166 aa, Nephila clavipes
GGYGPGGSGSGGVGPGGYGPGGSGGFYGPGGSEGPYGPSGTYGSGGGYGPGGAGGPYGPGSPGGAYGPGSPGGAYYPSSRVPDMVNGIMSAMQGSGFNYQMFGNMLSQYSSGSGTCNPNNVNVLMDALLAALHCLSNHGSSSFAPSPTPAAMSAYSNSVGRMFAYS

SEQ ID NO: 980 - protein, 161 aa, Nephilengys cruentata
GAGGSGPGGAGPGGAGPGGAGPGGAGPGGVGPGGAGGPYGSGGFGFGGAGGSGGPYVPGGAYGAGSGTPSYSGSRVPDLVNGIMRSMQGSGFNYQMFGNMLSKYASGSGACNSNDVNVLMDALLAALHCLSSHGSPSFGSSPTPSAMNAYSNSVRRMFQFS

SEQ ID NO: 981 - protein, 208 aa, Nephila madagascariensis
GGSGPGGAGGSGPGGAGPGGVGPGGSGPGGLGSGGSGPGGVGPGGSGPGGVGPGGYGPGGSGGLYGPGSYGPGGSGVPYGSSGTYGSGGGYGPGGAGGAYGPGSPGGAYGPGSGGSYYPSSRVPDMVNGIMSAMQGSGFNYQMFGNMLSQYSSGSGSCNPNNVNVLMDALLAALHCLSNHGSSSFAPSPTPAAMSAYSNSVGRMFAYS

SEQ ID NO: 982 - protein, 172 aa, Latrodectus hesperus
GINVDSDIGSVSSLILSGSTLQMTASGKGSYPGGESSQFSGLDSNIGLVGTQDVAIGVSQPVDISLNNILDSPQGLKSPQASSRINRLSSSVVNALGPNGLDINNFSDGLRTTLSQLSSSGLSKKEAAIETLMEAMVALLQVLNSAQVNQVDTSSTVVTSSSLAKALSSLFS

SEQ ID NO: 983 - protein, 170 aa, Araneus ventricosus
GGGVGSFGGQTSFGQTSGLTSSAASQSDFTQASGFVSSATSQGAFGQTSGIASFGAGPSTGLSVRSTLNSPNGLRSGSAAARISQLTSSVRNAIGPNGVDANALARSLQASFSSLRSSGMSSSDAKIEVLFETIVGLLQLLSNTQIRGVNMATASSVANSAARSFELVLA

SEQ ID NO: 984 - protein, 159 aa, Argiope trifasciata
GAGYTGPSGPSTGPSGYPGPLSGGASFGSGQSSFGQTSAFSASGAGQSAGVSVISSLNSPVGLRSASAASRLSQLTSSITNAVGANGVDANSLARSLQSSFSALRSSGMSSSDAKIEVLLETIVGLLQLLSNTQVRGVNPATASSVANSAARSFELVLA

SEQ ID NO: 985 - protein, 159 aa, Parawixia bistriata
GFARAYTGPQISQPAPLGVGPQVSQPRPLGVAPQTSGARPFGGVTGPSAGISLGSALNSPIGLRSGLAAARISQLTSSLGNAITPYGVDANALASSLQASFSTLQSSGMSASDAKIEVLLETIVGLLQLLSNTQIRGVNMATASSVASSAAKSFELVLS

SEQ ID NO: 986 - protein, 213 aa, Uloborus diversus
GASAADIATAIAASVATSLLSSGYLSDSNASQLGNSLASSISSVALNVAADLGVSLSASANLSSSLGASAGISSSFDASSASSTSLSSSSSLSSQQQVTSSAAVSLNSVITSPVGLASPQASSRVRYLSQLALNAISPQGFNVEAFVSQLGTIMAQARAMGMSASDATIETLLEGLLSLVQALGSCQAGSYNPARSAEASNIFLSAIQSTLSS

SEQ ID NO: 987 - protein, 155 aa, Agelenopsis aperta
GPGYGYAAYYASSYGYGPGVGSGAGAGSGSGAGSAAGAGSGSGAGAGRDVTNTVVNSVSRLSSPSSSSRVSSAVSGLLPNGNFNLGNLPGIVSNLSSSIASSGLSGCENLVQVLIEVVSALVHILGSANIGNINMNAASSTAAAVGQAIVNGLYS

SEQ ID NO: 988 - protein, 236 aa, Aphonopelma seemanni
GKAISSSAASAAASASAASAAATASAAASSSASTTRTTGATSAAGDFSVVADASADSSVLADEAARGAVGAVSGGGAASRSVGLIGSGFPGYVSSAPFSLISSVAGGGGSSPVPVSPLAGGLLPPSSYLSSPAAAERISSVIPLLLSGISPNRLDASLLGNTLGSLVAQVSLNRAGLSFSQIIVEALLELLCGVIQILSFAEITVVNTGTLSSTSFALAQAMSAAVRNTYRFHSTV

SEQ ID NO: 989 - protein, 162 aa, Artificial Sequence
  Description of Artificial Sequence: Synthetic polypeptide
GGYGPGSGQQGPGQQGPGQQGPGQQGPYGAGASAAAAAAGGYGPGSGQQGPGVRVAAPVASAAASRLSSSAASSRVSSAVSSLVSSGPTTPAALSNTISSAVSQISASNPGLSGCDVLVQALLEVVSALVHILGSSSVGQINYGASAQYAQMVGQSVTQALV

SEQ ID NO: 990 - protein, 141 aa, Araneus ventricosus
GGAGGAGQGGLGAGGAGQGGYGGGAYGGQGAASSAAAASAAASRLSSPSAASRVSSAVSSLVSSGGPSSPAALSSTISNVVSQISASNPGLSGCDVLVQALLEIVSALVHILGSANIGQVNSSAAGQSASLVGQSVYQALS

SEQ ID NO: 991 - protein, 153 aa, Argiope amoena
GGYGPGAGQQGPGGAGQQGPGGQGPYGPSVAAAASAAGGYGPGAGQQGPVASAAVSRLSSPQASSRVSSAVSSLVSSGPTNPAALSNAMSSVVSQVSASNPGLSGCDVLVQALLEIVSALVHILGSSSIGQINYAASSQYAQMVGQSVAQALA

SEQ ID NO: 992 - protein, 166 aa, Argiope amoena
GGYGPGAGQQGPGGAGQQGPGSQGPGGAGQQGPGGQGPYGPSAAAAASAAGGYGPGAGQQGPVASAAASRLSSPQASSRISSAVSSLVSSGPTNPAALSNAISSIVSQVSASNPGLSGCDALVQALLEIVSALVHILGSSSIGQINYAASSQYAQMVGQSVTQALV

SEQ ID NO: 993 - protein, 149 aa, Argiope amoena
GGYGPRYGQQGPGAGPYGPGAGATAAAAGGYGPGAGQQGPRSQAPVASAAAARLSSPQAGSRVSSAVSTLVSSGPTNPASLSNAIGSVVSQVSASNPGLPSCDVLVQALLEIVSALVHILGSSSIGQINYSASSQYARLVGQSIAQALG

SEQ ID NO: 994 - protein, 140 aa, Argiope amoena
GGQGGYGGLGSQGAGQGGYGGGAYGGQQGAAASAAAASAAASRLSSPGAASRVSSAVTSLVSSGGPTNSAALSNTISDVVSQISASNPGLSGCDVLVQALLEIVSALVHILGSANIGQVNSSSAGQSASLVGQSVYQALS

SEQ ID NO: 995 - protein, 121 aa, Artificial Sequence
  Description of Artificial Sequence: Synthetic polypeptide
GGYGPGAGQQGPGSQAPVASAAASRLSSPQASSRVSSAVSTLVSSGPTNPAALSNAISSVVSQVSASNPGLSGCDVLVQALLELVSALVHILGSSSIGQINYAASSQYAQMVGNSVAQALG

SEQ ID NO: 996 - protein, 163 aa, Argiope bruennichi
GGYGPGAGQQGPGSQGPGSGGQQGPGGQGPYGPSAAAAAAAAGGYGPGAGQQGPSSQAPVASAAASRLSSPQASARVSSAVSTLVSSGPTSPAALSNAISSVVSQVSASNPGLSGCDVLVQALLEIVSALVHILGSSSIGQINYAASSQYAQMVGNSVAQALG

SEQ ID NO: 997 - protein, 171 aa, Argiope bruennichi
GGQGGRGGFGGLSSQGAGGAGQGGSGAAAAAAAAGGDGGSGLGDYGAGRGYGAGLGGAGGAGVASAAASAAASRLSSPSAASRVSSAVTSLISGGGPTNPAALSNTFSNVVYQISVSSPGLSGCDVLIQALLELVSALVHILGSAIIGQVNSSAAGESASLVGQSVYQAFS

SEQ ID NO: 998 - protein, 177 aa, Argiope trifasciata
GGQGGQGGYGGLGSQGAGQGGYGQGGAAAAAASAGGQGGQGGYGGLGSQGAGQGGYGGGAFSGQQGGAASVATASAAASRLSSPGAASRVSSAVTSLVSSGGPTNSAALSNTISNVVSQISSSNPGLSGCDVLVQALLEIVSALVHILGSANIGQVNSSGVGRSASIVGQSINQAFS

SEQ ID NO: 999 - protein, 122 aa, Argiope trifasciata
GPGYGPGAGQQGPGSQAPVASAAASRLSSPQASSRVSSAVSTLVSSGPTNPASLSNAISSVVSQVSSSNPGLSGCDVLVQALLEIVSALVHILGSSSIGQINYAASSQYAQLVGQSLTQALG

SEQ ID NO: 1000 - protein, 220 aa, Avicularia juruensis
GAASSAAVGAAATSGAATSGAATSSSSATGVGGSVSSGASPASAGTATGGGISFLPVQTQRGFGLVPSPSGNIGANFPGSGEFGPSPLTSPVYGPGILGPGLVVPSLQGLLPPLFVLPSNSATERISSMVSSLLSAVSSNGLDASSFGDTIASLVSQISVNNSDLSSSQVLLEALLEILSGMVQILSYAEVGTVNTKTVSSTSAAVAQAISSAFSGNQNS

SEQ ID NO: 1001 - protein, 183 aa, Avicularia juruensis
GSGAARAAQTASAASAASASSSLAQLGSALAQSSSFAAAFDQGNSAASAAAIAYVLAQSAANKVGLSSYSAAISNAASAAVESVGGYASASAHAFAFASAVSQVLSNYGLINLSNALSLASSIANAVSASASSAAAVSSAAAATGATSSAAVGAAATCGAATSASSATGVGETVACATSPAST

SEQ ID NO: 1002 - protein, 185 aa, Avicularia juruensis
GTAAGGGISSLPVQTQPGFGFLLSPSGNIGPSVSGSGGFGPSPLPSPASDGFSPSPLPSQVYGPGILGPGLVAPSLEGLLPPLSILPSDSANERISSVVSSLLAAVSSNGLDASSLGDNLASLVSQISANNADLSSSQVMVEALLEVLSGIVQILSYAEVGAVNTETVSSTSSAVAQAISSAVLG

SEQ ID NO: 1003 - protein, 176 aa, Deinopis spinosa
GSGGYGSQGAGQGGQQGRGQGGQGQYGPGEGEQVPGQGGQGPAASAATASAGGPGEYGGQQGPGQGGQQQPGQGGQGPSAAAAASAAVGSGGYGSQGQQGQGGQGPTASAAAAAASVAGPGGYGASGQQGPRQGSQQGRFGPAAGQQGPGQTGQMGPGQQGPSGPSSAAAASAAAA

SEQ ID NO: 1004 - protein, 143 aa, Deinopis spinosa
GGPGGYGGPGQQGGGQQAPVQPRPYVPGMSGQIVTSDVSSTVSSAVSRMSTPGSGSRISNAVSNILSSGVSSSSGLSNVISNLSSSISTSNPGLSGCDVLVQVLLEVISALVHILSSASLGQVGSSPQNAQMVAANAVANAFS

SEQ ID NO: 1005 - protein, 142 aa, Deinopis spinosa
GPGGYGGPGQQGGGQQAPVQPRPYVPVTSGQIVTSDVSSTVSSAVSRMSTPGSGSRISNAVSNILSSGVSSSSGLSNAISNISSSISASNPGLSGCDVLVQVLLEVISALVHILGSASVGQVGSSPQNAQMVAANAVANAFS

SEQ ID NO: 1006 - protein, 198 aa, Diguetia canities
GAGGDSGLFLSSGDFGRGGAGAGAGAAAASAAAASAASAGAGRGTGFGERILIGGSRGFGGARVDAPAASTASASAAAASSGAGGGSRFGGLGVGVFGAGSGELSVASRISTMASSMSSLLSSNFSPVIFSSLANVIANGASAIAVAHPELSGAGVLTEALLEALVAFCYAHAGSIASASDVNLAVTTLASTMQGSLP

SEQ ID NO: 1007 - protein, 137 aa, Diguetia canities
GSGQGASFGISQQFGAPSGAASSAAAAAAAAAGASSPGALLVSADAPSRIASVSSSLNSVVSSGASASSFASIATQIADVAGQVSSVHPELSSLEVLVEALIEIIVALVHAQSGGASSASASASASALASQLGQLFG

SEQ ID NO: 1008 - protein, 168 aa, Dolomedes tenebrosus
GGAGAGQGGYGGQGGLGGYGQGAGAGASAAASASGAGSGQGGYGGQGGYGQGTGAGAASSAGVAVTVGNTVSRLSSPQAASRVSSAVSSLVSNGQVNVAALPSIISSLSSSISASSTAASDCEVLVQVLLEIVSALVQIVSSANVGYINPEASGSLNAVGSALAAAMG

SEQ ID NO: 1009 - protein, 165 aa, Euprosthenops australis
GQGGQGGYGRQSQGAGSAAAAAAAAAAAAAAGSGQGGYGGQGQGGYGQSSASASAAASAASTVANSVSRLSSPSAVSRVSSAVSSLVSNGQVNMAALPNIISNISSSVSASAPGASGCEVIVQALLEVITALVQIVSSSSVGYINPSAVNQITNVVANAMAQVMG

SEQ ID NO: 1010 - protein, 168 aa, Euprosthenops australis
GGQGQGGFGQGTVGNAAAAAAAAAAAAAAQQGGQGGFGGQGQRGFGQRAASAVASAASAADVGNTVANTVSRLSSPSAASRVSSAVANLVSNGQLNMAALPYIISNISSSVSASVPGASGCEVIVQALLEVVAALCQIVSSSNVGYINPSAVNDITNVVANAMAQVMG

SEQ ID NO: 1011 - protein, 168 aa, Euprosthenops australis
GESGQGGYGGRGQGGYGQGAGAAAAAAVAAAAAAAGQGGFGGLGGYGQGAGSATAAASSADVSTTVANSVSRLSSASAASRVYSVVSNLVSNGQVNIAALPNIISNVSSSVSASAPGASGCEVIVQVLLEIVAALTSIVSSASVGYINQYAVNDITNLVANAMAGVIG

SEQ ID NO: 1012 - protein, 114 aa, Artificial Sequence
  Description of Artificial Sequence: Synthetic polypeptide
GGYGPGSGGSPASGAASRLSSPQAGARVSSAVSALVASGPTSPAAVSSAISNVASQISASNPGLSGCDVLVQALLEIVSALVSILSSASIGQINYGASGQYAAMIGQSVAQALA

SEQ ID NO: 1013 - protein, 177 aa, Hypochilus thorelli
GASGAGQGQGYGQQAQVYNQGGSGSVATTAAAASGAVGVSQNYAQAPVYYGGSSSSYSSSITSYSSSVLPIAILQSPAGLTSSAAGSRMSSVATSITSLIPSNGSPFNYSAFSNTLASLINNIGNSNPGLSRNDVTIEALLEVITALLQVISNGELSAAASSYAAASLLQSIQQGYS

SEQ ID NO: 1014 - protein, 201 aa, Megahexura fulva
GAYGFTQAAASAVASVLLQAGVLNYGNATALASAYASAYASSVASAAASASAGASASSGASAYASAVAAAAAAASVSTSAGASASAGASGLSFSQAQASALSSSAAAYRISSLITSFVSGLSAGGGSVNYSVIANALASVASQISASNAGLSVSQVAVQALLEFSTALIQILASSQIGYVNTASAGSTASAFSQALAQTFA

SEQ ID NO: 1015 - protein, 166 aa, Nephila antipodiana
GGAGQGGYGGLGGQGAGQGGLGGQRAGAAAAAAGGAGQGGYGGLGSQGAGRGGYGGVGSGASAASAAASRLSSPEASSRVSSAVSNLVSSGPTNSAALSSTISNVVSQISASNPGLSGCDVLVQALLEVVSALIQILGSSSIGQVNYGTAGQAAQIVGQSVYQALG

SEQ ID NO: 1016 - protein, 151 aa, Nephila clavipes
GGAGQGGYGGLGGQGVGRGGLGGQGAGAAAAGGAGQGGYGGVGSGASAASAAASRLSSPQASSRLSSAVSNLVATGPTNSAALSSTISNVVSQIGASNPGLSGCDVLIQALLEVVSALIQILGSSSIGQVNYGSAGQATQIVGQSVYQALG

SEQ ID NO: 1017 - protein, 164 aa, Nephila clavipes
GPGGYGPAQQGPSGPGIAASAASAGPGGYGPAQQGPAGYGPGSAVAASAGAGSAGYGPGSQASAAASRLASPDSGARVASAVSNLVSSGPTSSAALSSVISNAVSQIGASNPGLSGCDVLIQALLEIVSACVTILSSSSIGQVNYGAASQFAQVVGQSVLSAFS

SEQ ID NO: 1018 - protein, 159 aa, Artificial Sequence
  Description of Artificial Sequence: Synthetic polypeptide
GPGGYGPVQQGPSGPGSAAGPGGYGPAQQGPARYGPGSAAAAAAAAGSAGYGPGPQASAAASRLASPDSGARVASAVSNLVSSGPTSSAALSSVISNAVSQIGASNPGLSGCDVLIQALLEIVSACVTILSSSSIGQVNYGAASQFAQVVGQSVLSAFS

SEQ ID NO: 1019 - protein, 153 aa, Artificial Sequence
  Description of Artificial Sequence: Synthetic polypeptide
GGAGQGGYGGLGSQGAGRGGYGGQGAGAAAAATGGAGQGGYGGVGSGASAASAAASRLSSPQASSRVSSAVSNLVASGPTNSAALSSTISNAVSQIGASNPGLSGCDVLIQALLEVVSALIHILGSSSIGQVNYGSAGQATQIVGQSVYQALG

SEQ ID NO: 1020 - protein, 164 aa, Artificial Sequence
  Description of Artificial Sequence: Synthetic polypeptide
GGAGQGGYGGLGGQGSGAAAAGTGQGGYGSLGGQGAGAAGAAAAAVGGAGQGGYGGVGSAAASAAASRLSSPEASSRVSSAVSNLVSSGPTNSAALSNTISNVVSQISSSNPGLSGCDVLVQALLEVVSALIHILGSSSIGQVNYGSAGQATQIVGQSVYQALG

SEQ ID NO: 1021 - protein, 153 aa, Artificial Sequence
  Description of Artificial Sequence: Synthetic polypeptide
GGAGQGGYGGLGSQGAGRGGYGGQGAGAAVAAIGGVGQGGYGGVGSGASAASAAASRLSSPEASSRVSSAVSNLVSSGPTNSAALSSTISNVVSQIGASNPGLSGCDVLIQALLEVVSALVHILGSSSIGQVNYGSAGQATQIVGQSVYQALG

SEQ ID NO: 1022 - protein, 142 aa, Nephilengys cruentata
GGSGRGGYGSQGAGQGAAAAAAGGAGQGGYGGAGSGAAAASAAASRLSSPEASSRVSSAVSNLVSSGPTNSAALSNTISSVVSQISASNPGLSGCDVLVQALLEVVSALIHILGSSSIGPVNYGSASQSTQIVGQSVYQALG

SEQ ID NO: 1023 - protein, 166 aa, Parawixia bistriata
GGYGPGSGQQGPGGAGQQGPGGQGPYGPGSSSAAAVGGYGPSSGLQGPAGQGPYGPGAAASAAAAAGASRLSSPQASSRVSSAVSSLVSSGPTNSAALTNTISSVVSQISASNPGLSGCDVLIQALLEIVSALVHILGYSSIGQINYDAAAQYASLVGQSVAQALA

SEQ ID NO: 1024 - protein, 179 aa, Parawixia bistriata
GVLGGQGGLGGLGSQGAGQGGYGQGGAGQGGAAAAAAAAAAGGLGGQGGRGGLGSQGAGQGGYGQGGAGASSAAAASAAASRLSSASAASRVSSAVSSLVSSGGPTNSAALSSTISNVVSQVSASNPGLSGCDVLVQALLEIVSALVHILGSSSIGQVNYNAAGQSASVVGQSFYQALA

SEQ ID NO: 1025 - protein, 230 aa, Peucetia viridans
GTGQGGVGGYGQGAGSSAGAGTGGVGQGGYGSYGSSYQSTSGISIALSTQSLGGQGQYGQGLGAGASAGAGAAVGTGLGQGGLGGYGQGSGSASAAASGSGSAIGGFGGYGQGAGLGAGTAADVGATVSNTVSRLSSPAATSRVSSAVSSLVANGAPNLSSLPNVISSLSNSVSASTPGASGCEILVQVLMEVVTALVQILSSANVSSVNAGDPSQAAMTVGQSVAAALG

SEQ ID NO: 1026 - protein, 208 aa, Poecilotheria regalis
GASSNASSAAAAASTVLAGVAPAGSSASSSAASASTGAGAAISSVGPAVGFGAGPAPAGGLVSGLPGYSPLNQGFTPYPGVPLPTGSGVSAPVPVSPLPLGLLPSSLDLSSPSATGRMSSLVRSLLSAVSSGGLNSSLLGSTLTSLVSQISSSRSDLSASQVLVEAVLEILSAVIQILSSATIGVVSTDSVGATSSAVAQAVSSAFAG

SEQ ID NO: 1027 - protein, 142 aa, Artificial Sequence
  Description of Artificial Sequence: Synthetic polypeptide
GGLGGGQGGYGSGLGGVGQGGQGALGGSRNSATNAISNSASNAVSLLSSPASNARISSAVSALASGAASGPGYLSSVISNVVSQVSSNSGGLVGCDTLVQALLEAAAALVHVLASSSGGQVNLNTAGYTSQMVSQTIAQVFA

SEQ ID NO: 1028 - protein, 138 aa, Artificial Sequence
  Description of Artificial Sequence: Synthetic polypeptide
GGLGGGQGGQQGAGRGGLQGAGQGGQGALGGSRNSAANAVSRLSSPASNARISSAVSALASGGASSPGYLSSIISNVVSQVSSNNDGLSGCDTVVQALLEVAAALVHVLASSNIGQVNLNTAGYTSQMVSQTIAQVFA

SEQ ID NO: 1029 - protein, 137 aa, Uloborus diversus
GGSGGQGGQGGYGSGGQGQGQGGYGSGAASAAAAASSSVSRLQSPASSSRVSSAVSTLASAGAANSGALSSVISNLSSSVASAHPDLSGCELLVQILLEVISALVALLGSSTVGPVDIGQSSQYSGLVANAIGNALA

SEQ ID NO: 1030 - protein, 133 aa, Araneus diadematus
GPGQQGPYGPSQQGPGSYGPSGQVSSVSASVSSAASRLSSPAASSRVSSTVSSLASSGPSDASVVSSALSNLVSQVSASQPGLSGCDVIVQALLELVSALVHILGSSSLGQVDYNGASYSAQRLSQALGNTLG

SEQ ID NO: 1031 - protein, 136 aa, Araneus diadematus
GSGAGAGSAAAAGAGVGAAGGYGGGAGAGAVAGASAGSYGGAVNRLSSAGAASRVSSNVAAIASAGAAALPNVISNIYSGVLSSGVSSSEALIQALLEVISALIHVLGSASIGNVSSVGVNSALNAVQNAVGAYAG

SEQ ID NO: 1032 - protein, 125 aa, Araneus diadematus
GQGGYGGSAYGGQGATASAAAASAAASRLSSPSAASRVSSAVSSLVSNGGPTSPAALSSSISNVVSQISASNPGLSGCDILVQALLEIISALVHILGSSSIGQVNSSSAGQSASIVGQSVYRALS

SEQ ID NO: 1033 - protein, 167 aa, Araneus diadematus
GGPGGPGGRGGPGRSGGRGGLEGAGASGGFGPVAGGASPGAGGSGSTTVTEVVSVTVSGGQPSSGVLPGGSYTPAAGGSARLPSLINGIMSSMQGGGFNYQNFGNVLSQFSTGTGTCNSNDLNLLMDALLAALHTLSYQGMSTVPSYPSPSAMSSYSQSVRRCFGYS

SEQ ID NO: 1034 - protein, 121 aa, Araneus diadematus
GVGPGGAYGPGAGGLSGVSSGAGGIRGGQTYGGSSRLPSLVNGLMGSMQPSGFNYQNFGNVMSQYATGSGTCNSNDVNLLMDALMAALHCLSYGSGSVPPTPTYSAMSAYNQSIRRMFAYS

SEQ ID NO: 1035 - protein, 121 aa, Araneus diadematus
GQQGYSSSSSAGASSAATASAAASRLSSTDSSSRVSSAVSSLVSNGPSNPVALANAVSRVMSQVNASSSGLSECDVLVQALLEILSALVHILGSATVGEVNYDATSQTAQMVSQTIAQVFA

SEQ ID NO: 1036 - protein, 132 aa, Araneus diadematus
GPGPQGPSGPGPQGPSPQGPSSGYDQSVVISSASSRLSSPSATSRISSAISTLKTSGPRNPVGLSTALGNILSQIQLTNPGLSGCESLVQALLEIVSALIQILSVSSVGPVDFSATGQSAAIVGQALMQSLG

SEQ ID NO: 1037 - protein, 154 aa, Araneus diadematus
GGAAGSGVGYGGASGVVTSSSSASAGGSGIITYGGYGYGAGAAAGAGAGAVAGSYGGAVNRLSSAEATNRVSSNVGAIVSGGVSALPSVISNIFSGVNASAAGASYGEALIQSLMEVVSVLLHILSNSSIGYVSSEGLGNSLSVVQQAIGPLAG

SEQ ID NO: 1038 - protein, 140 aa, Araneus diadematus
GSSFANAASAAPAVSVDGPVVVSGQVLPASLLTALAPVVSSSGLASSTASARVSSLAQSIASAISSSGGTLSVPTFLNLLSSAGAQVTTSSTLNSSQVTSQVLLEGIAALLQVINGAQIRSVNLANAPNVQQALVSALAG

SEQ ID NO: 1039 - protein, 197 aa, Agelenopsis aperta
GQGTSFASSATAGIRNIFGNPNTANNFVDCLKGGIQASPAFPRQEQADIQSIASSILSAGNTATKSKAIEQALSTALASSLAEIVITESGGQDYSKQITDLNGILSNCFIQTTGVENKRFVNSIQNLIRLLAESAVSETTNSIQIGPYASTSSNSFSDSSANDASGAYAFSQSSASTLASSSAFSSAFSSASSASAV

SEQ ID NO: 1040 - protein, 197 aa, Argiope argentata
GQSVAVTAVPSVFSSPNLASGFLQCLTFGIGNSPAFPTQEQQDLDAIAQVILNAVSTNTGATASARAQALSTALASSLTDLLIAESAESNYNNQLSELTGILSNCFIQTTGSDNPAFVSRIQSLISVLSQNTDVNIISTAGLPTAISGAGGFGFAKTASSSASQASASSFAQASSASLAASSSFSSAFSSANTLSAL

SEQ ID NO: 1041 - protein, 203 aa, Argiope bruennichi
GQSVAVTAVPSVFSSPNLASGFLQCLTFGIGNSPAFPTQEQQDLDAIAQVILNAVSSNTGATASARAQALSTALASSLTDLLIAESAESNYSNQLSELTGILSDCFIQTTGSDNPAFVSRIQSLISVLSQNADTNIISSAGIPSVSGRRGAGGLGFDNTARQSASSAASQASASSFAQASSASLAASSAFSSAFSSANSLSAL

SEQ ID NO: 1042 - protein, 140 aa, Argiope bruennichi
GQQSKFGQRFPSVSHIWNRKFSRISYSRTTRLGCHCPGDTQCRFKQHWRHSIGQSSGFKYSACIFSSANSLSALGNVAYQLGFNVANTLGIGNAPGLGAALSQAVSSVGVGASSSTYANVVSNAVGQFLAGQGVLNAANA

SEQ ID NO: 1043 - protein, 252 aa, Latrodectus hesperus
GLPANSLSGVSASVNIFNSPNAATSFLNCLRSNIESSPAFPFQEQADLDSIAEVILSDVSSVNTASSATSLALSTALASSLAELLVTESAEEDIDNQVVALSTILSQCFVETTGSPNPAFVASVKSLLGVLSQSASNYEFVETADESIAANVPGITTTGNFTPLNAIEQNFVSSLASSPSLARTFYSVSNADQAANIAYNLGLNIAPSLGIPNSEALASSLRQAVASAGEGVNSSTYANLVSNTLGQFLSSQ

SEQ ID NO: 1044 - protein, 240 aa, Nephila clavata
GQAISVATPVPSVFSSPSLASGFLGCLTTGIGLSPAFPFQEQQDLDDLAKVILSAVTSNTDTSKSARAQALSTALASSLADLLISESSGSSYQTQISALTNILSDCFVTTTGSNNPAFVSRVQTLIGVLSQSSSNAISGATGGSAFAQSQAFQQSASQNTGLSASRAGSTSSSTTTTTSAAASQAASQSASSSSSYAFAQAASSSLATSSAISRAFASVSSASAASSLAYTIGLSAARSL

SEQ ID NO: 1045 - protein, 174 aa, Araneus ventricosus
GQPIWTNPNAAMTMTNNLVQCASRSGVLTADQMDDMGMMADSVNSQMQKMGPNPPQHRLRAMNTAMAAEVAEVVATSPPQSYSAVLNTIGACLRESMMQATGSVDNAFTNEVMQLVKMLSADSANEVSTASASGASYATSTSSAVSSSQATGYSTAAGYGNAAGAGAGAAAAVS

SEQ ID NO: 1046 - protein, 164 aa, Metepeira grandiosa
GHIWGTPGAGKSVTGSIVQCAGQSGVFSGDQMQDLGDMADAVNRQLDRLGPNAPDHRLKGVTTMMAAGIADAAVNSPGQSLDVMINTISGCMTQAMSQAVGYVDQTLIREVAEMVNMLANENANAVSTSGGVSGGSYEVSQSSSASSATAQAGYSSSVQFGTSS

SEQ ID NO: 1047 - protein, 231 aa, Uloborus diversus
GALGQGASVWSSPQMAENFMNGFSMALSQAGAFSGQEMKDFDDVRDIMNSAMDKMIRSGKSGRGAMRAMNAAFGSAIAEIVAANGGKEYQIGAVLDAVTNTLLQLTGNADNGFLNEISRLITLFSSVEANDVSASAGADASGSSGPVGGYSSGAGAAVGQGTAQAVGYGGGAQGVASSAAAGATNYAQGVSTGSTQNVATSTVTTTTNVAGSTATGYNTGYGIGAAAGAAA

SEQ ID NO: 1048 - protein, 265 aa, Nephila clavipes
GRGIIANSPFSNPNTAEAFARSFVSNIVSSGEFGAQGAEDFDDIIQSLIQAQSMGKGRHDTKAKAKAMQVALASSIAELVIAESSGGDVQRKTNVISNALRNALMSTTGSPNEEFVHEVQDLIQMLSQEQINEVDTSGPGQYYRSSSSGGGGGGQGGPVVTETLTVTVGGSGGGQPSGAGPSGTGGYAPTGYAPSGSGAGGVRPSASGPSGSGPSGGSRPSSSGPSGTRPSPNGASGSSPGGIAPGGSNSGGAGVSGATGGPASS

SEQ ID NO: 1049 - protein, 239 aa, Nephila madagascariensis
GRGIIVNSPFSNPNTAEAFARSFVSNVVSSGEFGAQGAEDFDDIIQSLIQAQSMGKGRHDTKAKAKAMQVALASSIAELVIAESSGGDVQRKTNVISNALRNALMSTTGSPNEEFVHEVQDLIQMLSQEQINEVDTSGPGQYYRSSSSGGGGGGGGGPVITETLTVTVGGSGAGQPSGAGPSGTGGYAPTGYAPSGSGPGGVRPSASGPSGSGPSGSRPSSSGSSGTRPSANAAGGSSP

SEQ ID NO: 1050 - protein, 241 aa, Latrodectus hesperus
GVQVEGRKGHHHSSGSSKSPWANPAKANAFMKCLIQKISTSPVFPQQEKEDMEEIVETMMSAFSSMSTSGGSNAAKLQAMNMAFASSMAELVIAEDADNPDSISIKTEALAKSLQQCFKSTLGSVNRHFIAEIKDLIGMFAREAAAMEEAGDEEEETYPSAFEIPDQSISVPSADFISGMDTFIGFGGTSASGDVSAKLSKSLLSSLASSGVFRAAFNSRVSTPVAVQLTDALVQKIASNL

SEQ ID NO: 1051 - protein, 267 aa, Latrodectus hesperus
GLDYATASKLRKASQAVSKVRMGSDTNAYALAISSALAEVLSSSGKVADANINQIAPQLASGIVLGVSTTAPQFGVDLSSINVNLDISNVARNMQASIQGGPAPITAEGPDFGAGYPGGAPTDLSGLDMGAPSDGSRGGDATAKLLQALVPALLKSDVFRAIYKRGTRKQVVQYVTNSALQQAASSLGLDASTISQLQTKATQALSSVSADSDSTAYAKAFGLAIAQVLGTSGQVNDANVNQIGAKLATGILRGSSAVAPRLGIDLS

SEQ ID NO: 1052 - protein, 145 aa, Agelenopsis aperta
GQSNPWTDTATAESFISSVMSSVANQGCLSYDQIDDMQAVGDTMLATMDNLVRSGKSSSHMLKAMNMAMGTSIAEIVADGGGNLGSKVSCISNALSSAFLQTTGSVNTQFVNEIVSLISMFAQADTNEVGVGSGSGAGAGSGAGA

SEQ ID NO: 1053 - protein, 169 aa, Argiope bruennichi
GVGQAATPWENSQLAEDFINSFLRFIAQSGAFSPNQLDDMSSIGDTLKTAIEKMAQSRKSSKSKLQALNMAFASSMAEIAVAEQGGLSLEAKTNAIANALASAFLETTGFVNQQFVSEIKSLIYMIAQASSNEISGSAAAAGGGSGGGGGSGQGGYGQGASASASAAAA

SEQ ID NO: 1054 - protein, 252 aa, Argiope trifasciata
GVFSAGQGATPWENSQLAESFISRFLRFIGQSGAFSPNQLDDMSSIGDTLKTAIEKMAQSRKSSKSKLQALNMAFASSMAEIAVAEQGGLSLEAKTNAIASALSAAFLETTGYVNQQFVNEIKTLIFMIAQASSNEISGSAAAAGGSSGGGGGSGQGGYGQGAYASASAAAAYGSAPQGTGGPASQGPSQQGPVSQPSYGPSATVAVTAVGGRPQGPSAPRQQGPSQQGPGQQGPGGRGPYGPSAAAAAAAA

SEQ ID NO: 1055 - protein, 212 aa, Bothriocyrtum californicum
GRTKVTNVPWTDEAKGKKFLSTFLDYALDHGLFPQQERDDLEAISQNLIPVFRKTMDSGGNAAAKMKALNMAFASSIAEIAVQEGGAGSIEEKTQAVSEALAHAFLQTTGSVNIQFIKEIRALITLFAKEGQDNETENEIPTQQAYPELQPRGGGLQGQPGQYESVRANYAGSGGASRGQAAKEDSGAAAASSSSTSTSTTTTSSAAAAAAA

SEQ ID NO: 1056 - protein, 291 aa, Deinopis spinosa
GASSYASANTTPWRDAATAQAFIGNFMQAICYDPVINPQQCDDMNSMASTILAGVQNMARDGKISKAKLQAMNMGFASAIAEIALVEGGAPAENAVVNAMQSAIWQSTGSPNRSFINEMKALMKMLAQQSNFVAAAASTAASASSQATAPAYGGGSGSAVASASSQGTAPAYGGGSGSAGGQGQGQGSSGQQGQTQGTYQYTVSMSTATSTYGQQSAGQQGGQGGALQGGRQQGGQGPNGPGASAAASASAGAPAAAAPGGYGGPGQQGPGQGQKGPATSAAAAAASATAA

SEQ ID NO: 1057 - protein, 248 aa, Diguetia canities
GHQGPHRKTPWETPEMAENFMNNVRENLEASRIFPDELMKDMEAITNTMIAAVDGLEAQHRSSYASLQAMNTAFASSMAQLFATEQDYVDTEVIAGAIGKAYQQITGYENPHLASEVTRLIQLFREEDDLENEVEISFADTDNAIARAAAGAAAGSAAASSSADASATAEGASGDSGFLFSTGTFGRGGAGAGAGAAAASAAAASAAAAGAEGDRGLFFSTGDFGRGGAGAGAGAAAASAAAASAAAA

SEQ ID NO: 1058 - protein, 143 aa, Diguetia canities
GNTPFANKIMAEDFMNKFTNQLANSPYFSSQQKEDMSSIKDELISVIESMDSAHKSSAAKLQAMNMAFASAIADIAATEAYGADISLETSAIANALSEAFLQTTGVVNKRFISEIQELIYMFAQDASVQSNEIASSSSAAAAA

SEQ ID NO: 1059 - protein, 178 aa, Euprosthenops australis
GSSSLASHTTPWTNPGLAENFMNSFMQGLSSMPGFTASQLDDMSTIAQSMVQSIQSLAAQGRTSPNKLQALNMAFASSMAEIAASEEGGGSLSTKTSSIASAMSNAFLQTTGVVNQPFINEITQLVSMFAQAGMNDVSASASAGASAAASAGAPGYSPAPSYSSGGYASSAASAAAAA

SEQ ID NO: 1060 - protein, 157 aa, Kukulcania hibernalis
GFVVQGRQHNAANSPWSNAKTAEIFISKFISAILDSNAFTREQKEDMMSIGETIIPAMEKMSGSSKSIHAKLTALNMAFASSVAEIAVVEEGGSDINEKTYAIVAALNQAFLDTTGKVNKQFIAEIRDLVKMFASANEENEIGAALSAEIYTEQTGS

SEQ ID NO: 1061 - protein, 216 aa, Kukulcania hibernalis
GRAYGAGAGAGAEEGYGAGQGIANAVGRRRDRTGRGVFTVSTVSSNVVSQSEGLVEDTGPSGEGESAVSSAASAASAAQTGPERTGSEGASTRGGAGAGRGFGAGAGAGAESGKGGYGSGSGAGAGAGAGASGEGGFGEGQGYGAGAGAGASAGAGVGSGAGAGAGYGAGAGAGAGFGVGAGAGAGAGAGFGSGAGAGSGAGAGYGAGRAGGRGRG

SEQ ID NO: 1062 - protein, 178 aa, Nephila clavipes
GQNTPWSSTELADAFINAFMNEAGRTGAFTADQLDDMSTIGDTIKTAMDKMARSNKSSKGKLQALNMAFASSMAEIAAVEQGGLSVDAKTNAIADSLNSAFYQTTGAANPQFVNEIRSLINMFAQSSANEVSYGGGYGGQSAGAAASAAAAGGGGQGGYGNLGGQGAGAAAAAAASAA

SEQ ID NO: 1063 - protein, 178 aa, Nephila clavipes
GQNTPWSSTELADAFINAFLNEAGRTGAFTADQLDDMSTIGDTLKTAMDKMARSNKSSQSKLQALNMAFASSMAEIAAVEQGGLSVAEKTNAIADSLNSAFYQTTGAVNVQFVNEIRSLISMFAQASANEVSYGGGYGGGQGGQSAGAAAAAASAGAGQGGYGGLGGQGAGSAAAAAA

SEQ ID NO: 1064 - protein, 145 aa, Nephila clavipes
GQARSPWSDTATADAFIQNFLAAVSGSGAFTSDQLDDMSTIGDTIMSAMDKMARSNKSSQHKLQALNMAFASSMAEIAAVEQGGMSMAVKTNAIVDGLNSAFYMTTGAANPQFVNEMRSLISMISAASANEVSYGGGASAAAAAA

SEQ ID NO: 1065 - protein, 217 aa, Nephila madagascariensis
GIFIAGQANTPWSDTATADAFIQNFLGAVSGSGAFTPDQLDDMSTVGDTIMSAMDKMARSNKSSKSKLQALNMAFASSMAEIAAVEQGGQSMDVKTNAIANALDSAFYMTTGSTNQQFVNEMRSLINMLSAAAVNEVSYGGGASAAAATAGSYGQGPSGYAQGSSAASAAAPSGYVPSQTGQSGLGAAAAAAAVAPSGYGPSQQGPSGPGAATAAAA

SEQ ID NO: 1066 - protein, 146 aa, Araneus diadematus
GQNVADSPWSSNEKADFFIRSFNEVISRSSAFTSQQIDDMSSIGETLISSIDNMAKNGRSSTKKLQALNMAFASSMAEIAIAEQGGQSIDVKTNAIIDALNEAFIRTSGSVNNEFISEIRQLILMFSQVSMNDSASGSTAAANAGA

SEQ ID NO: 1067 - protein, 180 aa, Araneus diadematus
GARGIHVSSYTPFADPYTAENFARAFVNNIVNSGEFGAQDAADFDDITQSLLQAQNLHKRHDSNAKAKAMQMAFASSIAELVIAESEGANIQRRTSTVSNCMRNAMQSTTGGVDEEFMREIEDLIHLFSQESFNEVENYGPGTYYQSSTTGGAPVVTESVTVTVAGGGRGAPVNQGGQAP

SEQ ID NO: 1068 - protein, 173 aa, Araneus diadematus
GGGPTPWDSPSMAESFMSNFMSGIASSGAFSGGQIGDMQDITGTMQDSVNKMASTGRSSKSKLQAMNMAFASSMAEIAAAEAGGSSMAAKTSAITNALRGAFLQTTGVSNEQFINEIATLINLISQSNVNTVSASASAGGGGGYGAPAYGPSSYGPSQGPSSVSSVSVSSSAA

SEQ ID NO: 1069 - protein, 177 aa, Araneus diadematus
GRGIHVSILSNPNTAMTFARTFVSNIAGCGEFGSQGTEDFDDIMQSLIQAQSMGKGRHDTNAKAKAMQMALASSIAELIVEESGGVNMQQKTNAAINALRNALRSTSGKVDEGFVSEIVELVNLFSQEQFNEVDTGSSRQYYQSSTGGGQGGAPTVTETVTVSVGGGGGGAAQSSGP

SEQ ID NO: 1070 - protein, 163 aa, Araneus diadematus
GYPQQNYQPGIGIAQDDPLLDEGTGENFADVFTQTLENCGAFTHDEAQEYKEIIRVLTKAFGSFPDLQKAPPGVLKATAAGFASAVAERTAADVDHGQLFAKTRCVIQALREAFIVTTGVTNPYFISEVERLIEVFYITKGLPHSPVQQPLEEPQGQVQYQQQ

SEQ ID NO: 1071 - protein, 180 aa, Araneus diadematus
GASPTFSRSPWANPAKASSLMNCLITKIASSNVLPQQEKEDLESIMDTLMSAIKGASAKGKSSGAQLQAINMAVASSLAEIVVAEDVGNQASMAVKTQALSGALEQCFQTVMGTVDRKFIKEINDLISMFARQAATEANEIQDQGGFYAAGSSDSTSFQATSRTLQGSSQTTGGFGGAYP

SEQ ID NO: 1072 - protein, 167 aa, Araneus diadematus
GQSNPVNDDPYGFNETEKKFSDVFVDNVINSDAFTLMGENDIEEVTNILLTSIQLLKKSQDGDANQKKTLMVAFASSMAELILDRCDTTLGIEHKTEIITNALKNAYLQTTGKPNKPLIKEVRFLVALFLTLESPGFLDPLWNPYGRNPAFGLPPSYGVPLYPAPPQ

SEQ ID NO: 1073 - protein, 149 aa, Araneus diadematus
GLGQSPWKDASIAESFMNNFSNALARSGAFSSDQMDDIMSICDSIQSGIVRMDRSGKTSANKLQAMNMAFASAVAEIAIAEGGGQSAQVKTNAVADALASAFLQTTGVVNTQFINEIRTLISMFAQANVIDSSSGSVSASAGGAGQGGA

SEQ ID NO: 1074 - protein, 200 aa, Araneus diadematus
GFGQAATPWENTALAEAFINKFLESIGQTGTFSASQQDDMATIGDTLKTAMEKMAQSRKSSKSKLQALNMAFASSMAEIAVAEQGGLSIQAKTEAIASALSSAFLQTTGVINYQFVNEIKSLIYMIAQASTNEVGSSAASAGGGSGGGSYGQGSYVSASAAGTYGSAPQQGGYAPAQGPSQQGPVSQGPYGPSASVAAAA

SEQ ID NO: 1075 - protein, 128 aa, Araneus diadematus
GQQIWTNQAAVMAMTNNFVGCASQSGMLSADQMDDMAMMADTINMQATRMGPNAPRHKLKALNSAMAASIAEVAASSPPQSYSAVLNAIGSCLRDSMMQATGAVDEIFTTEVMKMVNLFAMDNANSVS

SEQ ID NO: 1076 - protein, 174 aa, Araneus diadematus
GQKIWTNPDAAMAMTNNLVQCAGRSGALTADQMDDLGMVSDSVNSQVRKMGANAPPHKIKAMSTAVAAGVAEVVASSPPQSYSAVLNTIGGCLRESMMQVTGSVDNTFTTEMMQMVNMFAADNANEVSASASGSGASYATGTSSAVSTSQATGYSTAGGYGTAAGAGAGAAAAA

SEQ ID NO: 1077 - protein, 181 aa, Aliatypus gulosus
GAASSSSTIITTKSASASAAADASAAATASAASRSSANAAASAFAQSFSSILLESGYFCSIFGSSISSSYAAAIASAASRAAAESNGYTTHAYACAKAVASAVERVTSGADAYAYAQAISDALSHALLYTGRLNTANANSLASAFAYAFANAAAQASASSASAGAASASGAASASGAGSAS

SEQ ID NO: 1078 - protein, 181 aa, Aliatypus gulosus
GAASSSSTIITTKSASAPAAADASAAATSSAASRSSANAAASAFAQSFSSILLESGYFGSIFGSSISSSYAAAIASAASRAAAESNGYTTHAYACAKAVASAVERVTSGADAYAYAQAISDALSHALLYTGRLNTANANSLASAFAYAFANAAAQASASSASAGAASASGAASASGAGSAS

SEQ ID NO: 1079 - protein, 181 aa, Aliatypus gulosus
GAASSSSTIITTKSASASAAADASAAATASAASRSSANAAASAFAQRFSSILLESGYFCSIFGSSISSSYAAAIASAASRAAAESNGYTTHAYACAKAVASAVERVTSGADAYAYAQAISGALSHALLYTGRLNTANANSLASAFAYAFANAAAQASASSASAGAASASGAASASGAGSAS

SEQ ID NO: 1080 - protein, 181 aa, Aliatypus gulosus; identical to SEQ ID NO: 1077

SEQ ID NO: 1081 - protein, 181 aa, Aliatypus gulosus
GAASSSSTIITTKSASASAAADASAAATASAASRSSANAAASAFAQSFSSILLESGYFCSIFGSSISSSYAAAIASAASRAAAESNGYTTHAYACAKAVASAVERVTSGADAYAYAQAISGALSHALLYTGRLNTANANSLASAFAYAFANAAAQASASSASAGAASASGAASASGAGSAS

SEQ ID NO: 1082 - protein, 181 aa, Aliatypus gulosus
GAASSSSTIITTKSASASAAADASAAATSSAASRSSANAAASAFAQSFSSILLESGYFGSIFGSSISSSYAAAIASAASRAAAESNGYTTHAYACAKAVASAVERVTSGADAYAYAQAISGALSHALLYTGRLNTANANSLASDFAYAFANAAAQATASSASAGAASASGAASASGAASAS

SEQ ID NO: 1083 - protein, 181 aa, Aliatypus gulosus
GAASSSSTIITTKSASASAAADASAAATASAASRSSANAAASAFAQSFSSILLESGYFGSIFGSSISSSYAAAIASAASRAAAESNGYTTHAYACAKAVASAVERVTSGADAYAYAQAISGALSYALLYTGRLNTANANSLASSFAYAFANAAAQASASSASAGAASASGAASASGAASAS

SEQ ID NO: 1084 - protein, 169 aa, Aptostichus sp.
GAAATSSSTSGASASSISSTTASSSSTGASSAAAGASHGAASAGGAFDFTRALFSELLESKIFSATTANFHSSTTASETLYATILKCLRELHFRYDECLQGATEVVSDLSVVSVGSGVHNYARVIAAFFERFFRKHDIPLSANYASRVAQYLISAMGSSVASADASSSS

SEQ ID NO: 1085 - protein, 169 aa, Aptostichus sp.
GAAATSSSTSGASASSISSTTASSSSTGASSAAAGASHGAASAGGAFDFTRALFSELLESKIFSATTANFHSSTTASETLYATILKCLRELHFRYDECLQGATEVVSDLSVVSVGSGVHNYAQVIAAFFERFFRKHDIPLSANYASRVAQYLISAMGSSVASADASSSS

SEQ ID NO: 1086 - protein, 169 aa, Aptostichus sp.; identical to SEQ ID NO: 1084

SEQ ID NO: 1087 - protein, 169 aa, Aptostichus sp.; identical to SEQ ID NO: 1084

SEQ ID NO: 1088 - protein, 169 aa, Aptostichus sp.; identical to SEQ ID NO: 1084

SEQ ID NO: 1089 - protein, 179 aa, Aptostichus sp.
GASSTTTATSESGITASSVATGAAAAISKTAAGSSSITYLARSFSRSLVSYLLQSAEFHSVFYSGISSGIASHIASTAGTSTAESLDLASLKSVIATACGKAMAATNSEGGPHAFANSLGSAITAVLIENAILTSENYDYFAKEFAHIFSISASKVVSATSAKSASEATSASWTAASRT

SEQ ID NO: 1090 - protein, 179 aa, Aptostichus sp.
GASSTTTATSESGITASSVATGAAAAISKTAAGSSSITYLARSFSRSLVSYLLQSAEFHSVFYSGISSGIASHIASTAGTSTAESLDLASLKSVIATACGKAMAATNSDGGPHAFANSLGSAITAVLIENAILTSENYDYFAKEFAHIFSISASKVVSATSAKSASEATSASWTAASRT

SEQ ID NO: 1091 - protein, 179 aa, Aptostichus sp.; identical to SEQ ID NO: 1089

SEQ ID NO: 1092 - protein, 142 aa, Araneus diadematus
GAGAGAGVGVGGAGGYGQGYGAGAGAGAGAGAGAGGAGGYGQGYGAGAAAAAGAGAGAAGGYGGGSGAGAGGAGGYGQGYGAGSGAGAGAAAAAGASAGAAGGYGGGAGVGAGAGAGAAGGYGQSYGSGAGAGAGAGAAAAA

SEQ ID NO: 1093 - protein, 122 aa, Araneus diadematus
GGAGGGGQGGLGSGGAGQGYGAGLGGQGGASAAAAAAGGQGGQGGQGGYGGLGSQGAGGAGQLGYGAGQESAAAAAAAAGGAGGGGQGGLGAGGAGQGYGAAGLGGQGGAGQGGGSGAAAAA

SEQ ID NO: 1094 - protein, 205 aa, Araneus diadematus
GGYGPGSGQQGPSQQGPGQQGPGGQGPYGPGASAAAAAAGGYGPGSGQQGPGGQGPYGPGSSAAAAAAGGNGPGSGQQGAGQQGPGQQGPGASAAAAAAGGYGPGSGQQGPGQQGPGGQGPYGPGASAAAAAAGGYGPGSGQGPGQQGPGGQGPYGPGASAAAAAAGGYGPGSGQQGPGQQGPGQQGPGGQGPYGPGASAAAAAA

SEQ ID NO: 1095 - protein, 240 aa, Araneus diadematus
GGYGPGYGQQGPGQQGPGGQGPYGPGASAASAASGGYGPGSGQQGPGQQGPGGQGPYGPGASAAAAAAGGYGPGSGQQGPGQQGPGQQGPGQQGPGGQGPYGPGASAAAAAAGGYGPGSGQQGPGQQGPGQQGPGQQGPGQQGPGQQGPGQQGPGQQGPGQQGPGGQGAYGPGASAAAGAAGGYGPGSGQQGPGQQGPGQQGPGQQGPGQQGPGQQGPGQQGPGQQGPYGPGASAAAAAA

SEQ ID NO: 1096 - protein, 232 aa, Araneus diadematus
GSGPGGYGPENQGPSGPGGYGPGGSGSSAAAAAAAASGPGGYGPGSQGPSGPGGSGGYGPGSQGASGPGGPGASAAAAAAAAAASGPGGYGPGSQGPSGPGAYGPGGPGSSAAAAAAAASGPGGYGPGSQGPSGPGVYGPGGPGSSAAAAAAAGSGPGGYGPENQGPSGPGGYGPGGSGSSAAAAAAAASGPGGYGPGSQGPSGPGGSGGYGPGSQGGSGPGASAAAAAAAA

SEQ ID NO: 1097 - protein, 193 aa, Atypoides riversi
GSATSSTTTTTTVSKSAAAAAAAAAAASSASSASRDSDRSSTAAEAYASSSAYASSNFENYLASDLSNSDEFESVYGSLYSSADAASYARSSAEYASNTLGLSKETSYALASAAAKAVSESGSGSSSYARAYAVAKSSAVVLQNSGVLSSSNSRSLSSAFAKAFASSSASSYASYQSRNTGTSRASSAGSGAA

SEQ ID NO: 1098 - protein, 193 aa, Atypoides riversi
GSATSSTTTTTTVSKSAAAAAAAAAAASSASSASRDSDRSSTAAEAYASSSAYASSNFENYLASDLSNSDEFESVYGSVYSSSDAASYARSSAGYASNTLGLSKETSYALASAAAKAVSESGSGSSSYARAYAVAKSSAAVLQNSGVLSSSNSRSLSSAFAKAFASSSASSYASYQSRNTGTSRASSAGSGAA

SEQ ID NO: 1099 - protein, 193 aa, Atypoides riversi
GSATSSTTTTTTVSKSAAAAAAAAAAASSASSASRDSDRSSTTAEAYASSSAYASSNFENYLASDLSNSDEFESVYGSVYSSSDAASYARSSAGYASNTLGLSKETSYALASAAAKAVSESGSGSSSYARAYAVAKSSAVVLQNSGVLSSSNSRSLSSAFAKAFASSSASSYASYKSRNTGTSRASSAGSGAA

SEQ ID NO: 1100 - protein, 193 aa, Atypoides riversi
GSATSSTTTTTTVSKSAAAAAAAAAAASSASSASRDSDRSSTAAEAYASSSAYASSNFENYLASDLSNSDEFESVYGSLYSSSDAASYARSSAGYASNTLGLSKETSYALASAAAKAVSESGSGSSSYARAYAVAKSSAVVLQNSGVLSSSNSRSLSSAFAKAFASSSASSYASYKSRNTGTSRASSAGSGAA

SEQ ID NO: 1101 - protein, 193 aa, Atypoides riversi
GSATSSTTTTTTVSKSAAAAAAAAAAASSASSARRDSDRSSSTAEAYASSSAYTSSNFENYLASDLSSSDEFESVYGSLYSSSDAASYARSSAEYASNTLGLSKETSYALASAAAKAVSESGSGSSSYARAYAVAKSSAVVLQNSGVLSSSNSRSLSSAFAKAFASSSASSYASYKSRNTGTSRASSAGSGAA

SEQ ID NO: 1102 - protein, 193 aa, Atypoides riversi
GSATSSTTTTTTVSKSAAAAAAAAAAASSASSASRDSDRSSTAAEAYASSSAYASSNFENYLASDLSNSDEFESVYGSLYSSADAASYASSSSEYASNTLGLSKETSYALASAAAKAVSESGSGSSSYARAYAVAKSSAVVLRNSGVLSSSNSRSLSSAFAKAFASSSASSYASYKSRNTGTSRASSAGSGAA

SEQ ID NO: 1103 - protein, 193 aa, Atypoides riversi
GSATSSTTTTTTVSKSAAAAAAAAAAASSASSARRDSDRSSSTAEAYASSSAYTSSNFENYLASDLSSSDEFESVYGSLYSSSDAASYARSSAEYASNTLGLSKETSYALASAAAKAVSESGSGSSSYARAYAVAKSSAVVLQNSGVLSSSNSRSLSSAFAKAFASSSASSYASSKSRNTGTSRASSAGSGAA

SEQ ID NO: 1104 - protein, 170 aa, Bothriocyrtum californicum
GSARSSSAAAASAAAFSSLSRALIYRLQQNQDFIYTFNSIETSDAARAITYSSALAAANAMGAGSSASQAVAFAAAKAAEGVPIRSSSYAYAEAITNAITPHFLALHLVNSANVDAFASDFTSSFASATASAASASAAASSAASAAAAATASSSSTSTSTKTTSSAAAAA

SEQ ID NO: 1105 - protein, 175 aa, Bothriocyrtum californicum
GSAISSSAAAASAAAFSSSLSRALIYRLQQNQDFIYTFNSIETSDAARAITYSSALAAANAIGAGSSASQAVAFAAAKAAEGVPIRSSSYAYAEAITNAITPHFLASHLVNSANVDAFASDFTSSFASATASAASASAAAASSAASAASAATTTASSSTSTSTTTTSSTAAAAAA

SEQ ID NO: 1106 - protein, 175 aa, Bothriocyrtum californicum
GAAASSRARAQAAAASSAAASAAAASSAFAEELAFLLWQSQDFISAFGSTASSSEATALARSSVMAAARAVGVAEAASAIASAAASAAAGVSHGSSAVAYARAIASAVARAFAQFGILTLSNAAAFGRQFARSFSSSAAASAASAASASAASAKSAAAAAASSSTTSTSTTTTST

SEQ ID NO: 1107 - protein, 175 aa, Bothriocyrtum californicum
GAAASSRTRAQAAAASSAAASAAAASSAFAEELTFLLRQSPNFISAFGSTASSSEATALARSSAIAAARAVGVAGAASAIASAAASAAAGVSHGSSAAAYARAIAFAVAQAFAPFGILTLAKAAAFASQFARSFSSSAAASAASAASASAASAKSAAAAAASSSTTSTSTTTTST

SEQ ID NO: 1108 - protein, 175 aa, Bothriocyrtum californicum
GAAASSRARAEAAAASSAAASAAAASSAFAEELTFLLRQSPNFISAFGSTASSSEATALARSSAIAAARAVGVAGAASAIASAAASAAAGVSHGSSAAAYARAIAFAVAQAFAPFGILTLAKAAAFASQFARSFSSSAAASAASAASASAASAKSAAAAAASSSTTSTSTTTTST

SEQ ID NO: 1109 - protein, 180 aa, Bothriocyrtum californicum
GAASAAGASSAAAASASAAAASFTQNLIYSLQESEIFYSALRSIASSGEASNLAYLAAERAAYGAGLDGIASSVASAAASAFANTALGSGAAAYAKALAYAIAPVLTRANIITLSNAASLATTYAKGFASSAASAAASASAASAAAASSAASASSAAAAAAASSSTSTSTTVSRSTAAAA

SEQ ID NO: 1110 - protein, 183 aa, Bothriocyrtum californicum
GAASAAGAAGASSAAAASASAAAASFTRNLIYSLQESEIFYSALRSIASSGEASNLAYLAAERAAYGAGLDGIASSVASAAASAFANTALGSGAAAYAKALAYAIAPVLTRANIITLSNAASLATTYARGFASSAASAAASASAASAAAASSAASASSAAAAAAASSSTSTSTTVSRSTAAAA

SEQ ID NO: 1111 - protein, 183 aa, Bothriocyrtum californicum; identical to SEQ ID NO: 1110

SEQ ID NO: 1112 - protein, 181 aa, Bothriocyrtum californicum
GAASAAGAAGASSAAAASASAAAASFSRNLIYSLQESEIFYSALRSIASSGEASNLAYLAAERAAYGAGLDGIASSVASAAASAFANTALGSGAAAYAKALAYAIAPVLTRANIITLSNAASLATTYARGFASSAASAAASASAASAAAASSAASASSAAAAASSSTSTSTTVSRSTAAAA

SEQ ID NO: 1113 - protein, 175 aa, Bothriocyrtum californicum
GAASAAGAAGASSAAAASASAAAASFTRNLIYSLQESEIFYSALRSIASSGEASNLAYLAAERAAYGAGLDGIASSVASAAASAFANTALGSGAAAYAKALAYAIAPVLTRANIITLSNAASLATTYARGFASSAASAAASASAASAAAASSAASASSSSAAAAAASSSTSTKAT

SEQ ID NO: 1114 - protein, 169 aa, Deinopis spinosa
GAGAGAGAGAGAGYSAGAGYGIGAGAGVGAGAGAGAGAGSGTGTGAGYGYGSSTQSSSTIYAATYQGGYGRVAGLGAGAGAGAGAGGGAGAGAGTGAGAGAGIGAGYGAGAGYGAGAGTGSGAGAGAGGGAAAGAGSGVGAGYGAGAGYGAGAGAGGGAGAGAGSGASA

SEQ ID NO: 1115 - protein, 174 aa, Deinopis spinosa
GAGYGAGAGAGGGAGAGTGYGGGAGYGTGSGAGYGAGVGYGAGAGAGGGAGAGAGGGTGAGAGGGAGAGYGAGTGYGAGAGAGGGAGAGAGAGAGAGAGAGSGAGAGYGAGAGYGAGAGAGGVAGAGAAGGAGAAGGAGAAGGAGAAGGAGAGAGAGSGAGAGAGGGARAGAGG

SEQ ID NO: 1116 - protein, 180 aa, Deinopis spinosa
GAGAGAGYGAGAGYGVGAGGGAGAGAGAGGGAGAGAGGGAGAGAGSGAGAGAGSGAGAGAGGGAGAGAGSGAGAGAGYGADAGVGGGAGAGTGYGGGAGYGSGAGAGSGAGAGAGYGAGAGSGTGVGFVAGTSNRVASTTYSTMYATGYNGGVGAGAGGGALSRLLAAGYGAGGGTATGA

SEQ ID NO: 1117 - protein, 174 aa, Deinopis spinosa
GAGYGAGAGAGAGSGAGLGAGAGAGFGAGAGAGVSAGAGAGIGAGAGAGVGAGAGAGFGAGAGAGVGAGFGAGAGAGVGAGAGAGVGAGAGAGSGAGVGAGVGAGFGAGVGAGVGAGAGAGAGVGAGAGVGAGAGAGVGAGAGAGVGAGAGAGVGAGAGAGFGAGVGAGVGAGA

SEQ ID NO: 1118 - protein, 158 aa, Deinopis spinosa
GIGAGAGAGSGVGAGAGAGSGTGTGAGYGYGSSAQSLSTRYSGAYQGSYGGAGAGAGAGAGAGAGAGSGAGAGSGTGYGAGSGAGAGAGSGSGAGAGTGAGYGAGSGAGVGVGAGAGSGYGAGGGAGAGAGAGGGAGAGTGGGTGAGAGAVYGAGAGA

SEQ ID NO: 1119 - protein, 159 aa, Deinopis spinosa
GAGLGAGTGAGAGAGASAGTGTGYGLGRYAQGTSVTYSSTYGNGYYGGLGAGSGTGAGGGAGAGAGSAAGAGAGAGSGAGLGAGAGAGAGAGFGAGAGAGVGAGAGAGIGAGAGAGVGAGAGAGFGAGVGGGAGAGSGAGVGAGVGAGVGAGAVVGAGA

SEQ ID NO: 1120 - protein, 180 aa, Deinopis spinosa
GAYSAAAAAAATATSGGAPGGYGGYGPGIGGAYGPASSTGTGSGSGSGAGAAGGGGSGGLGSSGGNGGLGSGNGGSGASAAASASAASSSPGSGGYGPGQGAGFGSGSAAAGGSGTGSGAGGPGSGGYGGPQFFASNTFASAYGGQGLLGTSGYGTGQGGASGTGSSGGGGSGSGTGSNS

SEQ ID NO: 1121 - protein, 175 aa, Deinopis spinosa
GASSAAAAAAATATSGGAPGGYGGYGPGIGGAFVPASTTGTGSGSGSGAGAAGSGGLGGLGSSGGSGGLGGGNGGSGASAAASAAAASSSPGSGGYGPGQGVGSGSGSGAAGGSGTGSGAGGPGSGGYGGPQFFASAYGGQGLLGTSGYGNGQGGASGTGSGGVGGSGSGAGSNS

SEQ ID NO: 1122 - protein, 233 aa, Dolomedes tenebrosus
GGAGSGQGGYGGQGGLGGYGQGAGAGAAAATAAGGAGSGQGDYGDQGGLGGYGQGSGAGSATAPAAGGSGFGQGGFGNRGGKGAYGQSAGAGVGAAATAAAGGAGSGQGGYGDQGGLGGYGQGAGAGAASAAAGGGDGYEQGGYGNQGGLGSFGQGAGAGAAAAASAGGAGSGRGGYGDQGGLGGYGQGAGAGAASAAAGGGDGYGQGYYGDQGGRGGYGQGSGAGSATAAAA

SEQ ID NO: 1123 - protein, 278 aa, Dolomedes tenebrosus
GGAGFGQGGYGQGGYGNQGGLGSFGQGAGAGAAAAASAGGAGSGRGGYGDQGGLGGYGQGAGAGAAAAAAGGGDGYGQGGYGNQGGLGSFGQGAGAGAAAAASAGGAGSGRGGYGQGGYGNQGGLGSFGQGAGAGAAAAASAGGAGSGRGGYGDQGGLGGYGQGAGSGAAAAAAGGGDGYGQGGYGNQGGLGSFGQGAGAGAAAAASAGGAGSGRGGYGQGGYGNQGGLGSFGQGAGAGAAAAASAGGAGSGRGGYGDQGGLGGYGQGAGAGAASAAA

SEQ ID NO: 1124 - protein, 169 aa, Dolomedes tenebrosus
GGGDGYGQGGYGNQRGVGSYGQGAGAGAAATSAAGGAGSGRGGYGEQGGLGGYGQGAGAGAASTAAGGGDGYGQGGYGNQGGRGSYGQGSGAGAGAAVAAAAGGAVSGQGGYDGEGGQGGYGQGSGAGAAVAAASGGTGAGQGGYGSQGSQAGYGQGAGFRAAAATAAA

SEQ ID NO: 1125 - protein, 163 aa, Artificial Sequence
  Description of Artificial Sequence: Synthetic polypeptide
GAYAYAYAIANASQIAASVASAVASSASAAAAAASSSAAAAAGASSAAGAASSSSTTTTTSTSSSAAAAAAAAAAASASGASSASAAASASAAASAFSSALISDLLGIGVFGNTFGSIGSASAASSIASAAAQAALSGLGLSYLASAGASAVASAVAGVGVGA

SEQ ID NO: 1126 - protein, 164 aa, Euagrus chisoseus
GAYAYAYAIANAFASILANTGLLSVSSAASVASSVASAIATSVSSSSAAAAASASAAAAASASAASSASASSSASAAAAAGASAAAGAASSASASAAASAFSSAFISALLGFSQFNSVFGSITSASLGLGIAANAVQSGLASLGLGAAASAAASAVANAGLNGS

SEQ ID NO: 1127 - protein, 178 aa, Euagrus chisoseus
GAYAYATAIASAIGNALLGAGFLTAGNASQIAASVASAVASSASAAAAAASSSAAAAGASSAAGAASSSSTTTTTSTSSSAAAAAAAAAAASASGASSASAAASASAAASAFSSALIGDLLGIGVFGNTFGSIGSASAASSIASAAAQAALSGLGLSYLASAGASAVASAVAGVGVGA

SEQ ID NO: 1128 - protein, 252 aa, Plectreurys tristis
GAGAGAGAGAGAGAGAGSGASTSVSTSSSSGSGAGAGAGSGAGSGAGAGSGAGAGAGAGGAGAGFGSGLGLGYGVGLSSAQAQAQAQAAAQAQAQAQAQAYAAAQAQAQAQAQAQAAAAAAAAAAAGAGAGAGAGAGAGAGAGSGASTSVSTSSSSGSGAGAGAGSGAGSGAGAGSGAGAGAGAGGAGAGFGSGLGLGYGVGLSSAQAQAQAQAAAQAQAQAQAQAYAAAQAQAQAQAQAQAAAAAAAAAAA

SEQ ID NO: 1129 - protein, 252 aa, Plectreurys tristis
GAGAGAGAGAGAGAGAGSGASTSVSTSSSSGSGAGAGAGSGAGSGAGAGSGAGAGAGAGGAGAAFGSGLGLGYGVGLSSAQAQAQAQAAAQAQADAQAQAYAAAQAQAQAQAQAQAAAAAAAAAAAGAGAGAGAGSGAGAGAGSGASTSVSTSSSSGSGAGAGAGSGAGSGAGAGSGAGAGAGAGGAGAGFGSGLGLGYGVGLSSAQAQAQAQAAAQAQADAQAQAYAAAQAQAQAQAQAQAAAAAAAAAAA

SEQ ID NO: 1130 - protein, 252 aa, Plectreurys tristis
GAGAGAGAGSGAGAGAGSGASTSVSTSSSSGSGAGAGAGSGAGSGAGAGSGAGAGAGAGGAGAGFGSGLGLGYGVGLSSAQAQAQSAAAARAQADAQAQAYAAAQAQAQAQAQAQAAAAAAAAAAAGAGAGAGAGAGAGAGAGSGASTSVSTSSSSASGAGAGAGSGAGSGAGAGSGAGAGAGAGGAGAGFGSGLGLGYGVGLSSAQAQAQAQAAAQAQAQAQAQALAAAQAQAQAQAQAQAAAATAAAAAA

SEQ ID NO: 1131 - protein, 194 aa, Artificial Sequence
  Description of Artificial Sequence: Synthetic polypeptide
GQGTDSVASSASSSASASSSATGPDTGYPVGYYGAGQAEAAASAAAAAAASAAEAATIAGLGYGRQGQGTDSSASSVSTSTSVSSLATGPGSRYPVRDYGADQAEAAASAAAAASAAEEIASLGYGRQGQGTDSVASSASSSASASSSATGPDTGYPVGYYGAGQAEAAASAAAAAAASAAEAATIAGLGYGRQ

SEQ ID NO: 1132 - protein, 198 aa, Plectreurys tristis
GQGTDSSASSVSTSTSVSSSATGPDTGYPVGYYGAGQAEAAASAAAAAAASAAEAATIAGLGYGRQGQGTDSSASSVSTSTSVSSSATGPDMGYPVGNYGAGQAEAAASAAAAAAASAAEAATIASLGYGRQGQGTDSSASSVSTSTSVSSSATGPGSRYPVRDYGADQAEAAASAAAAAAAAASAAEEIASLGYGRQ

SEQ ID NO: 1133 - protein, 198 aa, Plectreurys tristis
GQGTDSVASSASSSASASSSATGPDTGYPVGYYGAGQAEAAASAAAAAAASAAEAATIAGLGYGRQGQGTDSSASSVSTSTSVSSSATGPGSRYPVRDYGADQAEAAASATAAAAAAASAAEEIASLGYGRQGQGTDSVASSASSSASASSSATGPDTGYPVGYYGAGQAEAAASAAAAAAASAAEAATIAGLGYGRQ

SEQ ID NO: 1134 - protein, 207 aa, Plectreurys tristis
GVSLSSSQATSVASAISSSLYAFNYQASAASSAAAQSSAQTASTSAKQTAASTSASTAATSTTQTAATTSASTAASSQTVQKASTSSAASTAASKSQSSSAGSSRTTSTAAASASSSYAFAQSLSQYLLSSQQFTTAFASSTAVASSQQYAEAMAQSVATSLGLGYTYASALSVAMAQAISGVGGGASAYSYATAISQAISRALTSS

SEQ ID NO: 1135 - protein, 206 aa, Artificial Sequence
  Description of Artificial Sequence: Synthetic polypeptide
GVSLSSSQATSVASAISSSLYAFNYQASAASSAAAQSSAQTASTSAKQTAASTSASTAATSTTQTAATTSASTAASSQTVQKASTSSAASTAASKSQSSSVGSSTTSTAAASASSSYAFAQSLSQYLLSSQQFTTAFASSTAVASSQQYAEAMAQSVATSLGLGYTYTSALSVAMAQAISGVGGGASAYSYATAISQAISRVLTSS

SEQ ID NO: 1136 - protein, 206 aa, Plectreurys tristis
GISLSSSQATSVASAISSSLYAFNYQASAASSAAAQSSAQTASTSAKQTAASTSASTAATSTTQTAATTSASTAASSQTVQKASTSSAASTAASKSQSSSVGSSTTSTAAASASSSYAFAQSLSQYLLSSQQFTTAFASSTAVASSQQYAEAMAQSVATSLGLGYTYTSALSVAMAQAISGVGGGASAYSYATAISQAISRVLTSS

SEQ ID NO: 1137 - protein, 181 aa, Artificial Sequence
  Description of Artificial Sequence: Synthetic polypeptide
GSSAYDSQFSESSSASSAAASAFSEQTSYDISSDLSSASSATAAAASSSAYESQFSDASSGSSAAAAASSQQNSYDTDALYSASSAASAAASASAYELEFSDASSSSSAVAVASSQQGSYDTSSDFSSASSAAAAAASAYESKFLDASSSSSAAAAASSQQSSYETSSDLVSASSAAAAAA

SEQ ID NO: 1138 - protein, 177 aa, Plectreurys tristis
GASAYQSQFLDASSSSNAAATTSSRQSSYDTSSDFSSASIAAAAAASASSYESQFSDASSSSNAAAAASSQQSSYDTSSDLVSAASASAYESQFLDASSSSNAAATTSSQQSSYDTSSDFSSASIAAAAAASASSYESQFSDASSSSNAAAAASSQQSSYDTSSDLVSASSAAAAAA

SEQ ID NO: 1139 - protein, 228 aa, Plectreurys tristis
GASSYESQFSDASSSSNAAAAASSQQSSYDTSSDLVSASSAAAAAASASAYESQFSDASSSRNAAAAASSQQSSYDTSSDLVSASSAAAAAASASSYESQFLDASSSSNAAATTSSQQSSYDTSSDFSSASIAAAVAASASSYESQFSDASSSSKAAAAASSQQSSYDTSSDLVSASSAAAAAASASSYESQFSDASSSSNAAAAASSQQSSYDTSSDFSSANSAALA

SEQ ID NO: 1140 - protein, 239 aa, Artificial Sequence
  Description of Artificial Sequence: Synthetic polypeptide
GAAQKQPSGESSVATASAAATSVTSGGAPVGKPGVPAPIFYPQGPLQQGPAPGPSNVQPGTSQQGPIGGVGGSNAFSSSFASALSLNRGFTEVISSASATAVASAFQKGLAPYGTAFALSAASAAADAYNSIGSGANAFAYAQAFARVLYPLVRQYGLSSSGKASAFASAIASSFSSGTSGQGPSIGQQQPPVTISAASASAGASAAAVGGGQVGQGPYGGQQQSTAASASAAAATATS

SEQ ID NO: 1141 - protein, 239 aa, Plectreurys tristis; identical to SEQ ID NO: 1140

SEQ ID NO: 1142 - protein, 239 aa, Plectreurys tristis
GAAQKQPSGESSVATASAAATSVTSGGAPVGKPGVPAPIFYPQGPLQQGPAPGPSNVQPGTSQQGPIGGVGGSNAFSSSFASALSLNRGFTEVISSASATAVASAFQKGLAPYGTAFALSAASAAADAYNSIGSGANAFAYAQAFARVLYPLVQQYGLSSSAKASAFASAIASSFSSGTSGQGPSIGQQQPPVTISAASASAGASAAAVGGGQVGQGPYGGQQQSTAASASAAAATATS

SEQ ID NO: 1143 - protein, 239 aa, Plectreurys tristis
GGAQKQPSGESSVATASAAATSVTSAGAPVGKPGVPAPIFYPQGPLQQGPAPGPSNVQPGTSQQGPIGGVGGSNAFSSSFASALSLNRGFTEVISSASATAVASAFQKGLAPYGTAFALSAASAAADAYNSIGSGANAFAYAQAFARVLYPLVQQYGLSSSAKASAFASAIASSFSSGTSGQGPSNGQQQPPVTISAASASAGASAAAVGGGQVSQGPYGGQQQSTAASASAAAATATS

SEQ ID NO: 1144 - protein, 239 aa, Plectreurys tristis
GGAQKQPSGESSVATASAAATSVTSAGAPGGKPGVPAPIFYPQGPLQQGPAPGPSNVQPGTSQQGPIGGVGGSNAFSSSFASALSLNRGFTEVISSASATAVASAFQKGLAPYGTAFALSAASAAADAYNSIGSGANAFAYAQAFARVLYPLVQQYGLSSSAKASAFASAIASSFSSGTSGQGPSIGQQQPPVTISAASASAGASAAAVGGGQVGQGPYGGQQQSTAASASAAAATATS

SEQ ID NO: 1145 - protein, 242 aa, Plectreurys tristis
GGAQKQPSGESSVATASAAATSVTSAGAPVGKPGVPAPIFYPQGPLQQGPAPGPSYVQPATSQQGPIGGAGRSNAFSSSFASALSGNRGFSEVISSASATAVASAFQKGLAPYGTAFALSAASAAADAYNSIGSGANAFAYAQAFARVLYPLVQQYGLSSSAKASAFASAIASSFSSGAAGQGQSIPYGGQQQPPMTISAASASAGASAAAVKGGQVGQGPYGGQQQSTAASASAAATTATA

SEQ ID NO: 1146 - protein, 245 aa, Plectreurys tristis
GGAQKHPSGEYSVATASAAATSVTSGGAPVGKPGVPAPIFYPQGPLQQGPAPGPSNVQPGTSQQGPIGGVGESNTFSSSFASALGGNRGFSGVISSASATAVASAFQKGLAPYGTAFALSAASAAADAYNSIGSGASASAYAQAFARVLYPLLQQYGLSSSADASAFASAIASSFSTGVAGQGPSVPYVGQQQPSIMVSAASASAAASAAAVGGGPVVQGPYDGGQPQQPNIAASAAAAATATSS

SEQ ID NO: 1147 - protein, 194 aa, Agelenopsis aperta
GSLGYQLALQTANSLGIQNAASLASAVAQAVSAVGVRASSYAYASAISNTVGQFLTSQGLLSQSNASALASSFASAFAASAASASASASSSSYAQSSAAAQSQSAASAFTRAASAAASQASSQSASQAGSYGRTTTTSTSQSGAQAGSQAASQASSSSWAAASASAFAQSSASSLASSSAFSSAFSSASSASAV

SEQ ID NO: 1148 - protein, 194 aa, Agelenopsis aperta
GSLCYQLALQTANSLGIQNAASLASAVSQAVSAVGVRASSYAYASAISNTVGQFLISQGLLSQSNASALASSFASAFAASAASASASASSSSYAQSSAAAQSQSAASAFSRAASAAASQASSQSASQAGSYGRTTTTSTSESGAQAASQAASQASSSSWAAASASAFAQSSASSLASSSAFASAFSSASSTSAV

SEQ ID NO: 1149 - protein, 182 aa, Araneus gemmoides
GNVGYQLGLKVANSLGLGNAQALASSLSQAVSAVGVGASSNAYANAVSNAVGQVLAGQGILNAANAGSLASSFASALSSSAASVASQSASQSQAASQSQAAASAFRQAASQSASQSASRAGSQSSTKTTSTSTSGSQADSRSASSSASQASASAFAQQSSASLSSSSSFSSAFSSATSISAV

SEQ ID NO: 1150 - protein, 182 aa, Araneus gemmoides
GNVGYQLGLKVANSLGLGNAQALASSLSQAVSAVGVGASSNAYANAVSNAVGQVLAGQGILNAANAGSLASSFASALSSSAASVASQSASQSQAASQSQAAASAFRQAASQSASQSDSRAGSQSSTKTTSTSTSGSQADSRSASSSASQASASAFAQQSSASLSSSSSFSSAFSSATSISAV

SEQ ID NO: 1151 - protein, 182 aa, Araneus gemmoides; identical to SEQ ID NO: 1149

SEQ ID NO: 1152 - protein, 176 aa, Artificial Sequence
  Description of Artificial Sequence: Synthetic polypeptide
GSQAASQSASSSASQASASSFAQASSASLAASSSFSSAFSSATSLSALGNVAYQLGFNVGTNLGLTNAAGLAAAISQAASSVGVGASSGAYANALSNAAAQFLSAQGILNTVNAGSLASSFASALSSVAASAAAQASSQSQAASSAFSRAASQSASQSAARSGAQSSSSTTTTSTS

SEQ ID NO: 1153 - protein, 176 aa, Argiope amoena
GSQAASQSASSSASQASASSFAQASSASLAASSSFSSAFSSATSLSALGNVAYQLGFDVGTNLGLTNAAGLAAAFSQAASSVGVGGSSGAYANALSNAAAQFLSAQGILNTVNAGSLASSFASALSSVAASAAAQASSQSQAASSAFSRAASQSASQSAARSGAQSSSSTTTTSSS

SEQ ID NO: 1154 - protein, 180 aa, Argiope argentata
GNVAYQLGFNVANTLGLGNAAGLGAALSQAVSSVGVGASSGTYANAVSNAVGQFLAGQGILNAANAASLASSFASALSASAASVASSSAAQSASQSQAAASAFSRAASQSASQSAALSGAQSSSTTTTTSTSGSQAASQSASSSASQASASSFAQASSASLAASSSFSSAFSSANTLSAL

SEQ ID NO: 1155 - protein, 180 aa, Argiope argentata
GNVAYQLGFNVANTLGLGNTAGLGAALSQAVSSVGVGASSATYANAVSNAVGQFLAGQGILNGANAASLASSFASALSASAASVASSSAAQSATQSQAAASAFSRAASQSASQSAARSGAQSSSTTTTSSTSGSQAASQSASSSASQASASSFAQASSASLAASSSFSSAFSSANTLSAL

SEQ ID NO: 1156 - protein, 180 aa, Argiope argentata
GNVAYQLGFNVANTLGLGNASGLGAALSQAVSSVGVGASSGTYANAVSNAVGQFLAGQGILNGANAASLASSFASALSASAASVASSSAAQSASQSQAAASAFSRAASQSASQSAARSGAQSSSTTTTSSTSGSQAASQSASSSASQASASSFAQASSASLAASSSFSSVFSSANTLSAL

SEQ ID NO: 1157 - protein, 180 aa, Argiope aurantia
GSLASSFASALSASAASVASSAAAQAASQSQAAASAFSRAASQSASQSAARSGAQSSSTTTTTSTAGSQAASQFASSAASQASASSFARASSASLAASSSFSSAFSSANSLSALGNVGYQLGFNVANNLGIGNAAGLGNALSQAVSSVGVGASSSSYANAVSNAVGQLLAGQGILNAANA

SEQ ID NO: 1158 - protein, 180 aa, Argiope aurantia
GSLASSFASALSASAASVASSAAAQAASQSQAAASAFSRAASQSASQSAARSGAQSISTTTTTSTAGSQAASQSASSAASQASASSFARASSASLAASSSFSSAFSSANSLSALGNVGYQLGFNVANNLGIGNAAGLGNALSQAVSSVGVGASSSTYANAVSNAVGQFLAGQGILNAANA

SEQ ID NO: 1159 - protein, 180 aa, Argiope aurantia
GSLASSFASALSASAASVASSAAAQAASQSQAAASAFSRAASQSASQSAARSGAQSSSTTTTTSTAGSQAASQFASSAASQASASSFARASSASLAASSSFSSAFSSANSLSALGNVGYQLGFNVANNLGISNAAGLGNALSQAVSSVGVGASSSSYANAVSNAVGQFLAGQGILNAANA

SEQ ID NO: 1160 - protein, 180 aa, Argiope aurantia
GSLASSFASALSASAASVASSAAAQAASQSQAAASAFSRAASQSASQSAARSGAQSFSTTTTTSTAGSQAASQSASSAASQASASSFARASSASLAASSAFSSAFSSANSLSALGNVAYQLGFNVANTLGIGNAAGLGNALSQAVSSVGVGASSSTYANAVSNAVGQFLAGQGVLNAGNA

SEQ ID NO: 1161 - protein, 180 aa, Argiope bruennichi
GNVGYQLGFNVANTLGIGNAPGLGNALSQAASSVGVGASSSAYANAVSNAVGQFLAGQGVLNAGNAGSLASSFANALSASAASVASSAAAQSAFQSQAAASAFSRAASQSASRGAARSGAQSSSTTTTTSTSGSQAASQSASSAAAQASASSFAQASSASLAASSAFSSAFSSANSLSAL

SEQ ID NO: 1162 - protein, 180 aa, Argiope bruennichi
GNVGYQLGFNVANTLGIGNAPGLGNALSQAVSSVGVGASSSAYANAVSNAVGQFLAGQGVLNIGNAGSLASSFANALSASAASVASSAAAQSASQSQAAASAFSRAASQSASRGAARSGAQSSSTTTTTSTSGSQAASQSASSAAAQASASSFAQASSASLAASSAFSSAFSSANSLSAL

SEQ ID NO: 1163 - protein, 180 aa, Argiope bruennichi; identical to SEQ ID NO: 1162

SEQ ID NO: 1164 - protein, 180 aa, Argiope bruennichi
GNVGYQLGFNVANTLGIGNAPGLGNALSQAVSSVGVGASSRAYANAVSNAVGQFLAGQGVLNVGNAGSLASSFANALSASAASVASSAAAQSASQSQAAASAFSRAASQSASRGAARSGAQSSSTTTTTSTSGSQAASQSASSAAAQASASSFAQASSASLAASSAFSSAFSSANSLSAL

SEQ ID NO: 1165 - protein, 180 aa, Argiope bruennichi
GNVGYQLGFNVANTLGIGNAPSLGNALSQAVSSVGVGASSSAYANAVSNAVGQFLAGQGVLNAGNAGSLASSFANALSASAASVASSAAAQSAFQSQAAASAFSRAASQSASQSAARSGAQSSSTTTTTSTSGSQAASQSASSAAAQASASSFAQASSASLAASSAFSSAFSSANSLSAL

SEQ ID NO: 1166 - protein, 180 aa, Argiope bruennichi; identical to SEQ ID NO: 1162

SEQ ID NO: 1167 - protein, 180 aa, Argiope bruennichi
GNVGYQLGFNVANTLGIGNAPGLGNALSQAVSSVGVGASSSAYANAVSNAVGQFLAGQGVLNAGNAGSLASSFANALSASAASVASSAAAQSAFQSQAAASAFSRAASQSASQSAARSGAQSSSTTTTTSTSGSQAASQSASSAAAQASASSFAQASSASLAASSAFSSAFSSANSLSAL

SEQ ID NO: 1168 - protein, 180 aa, Argiope bruennichi; identical to SEQ ID NO: 1162

SEQ ID NO: 1169 - protein, 180 aa, Argiope bruennichi
GNVGYQLGFNVANTLGIGNAPGLGNALSQAVSSVGVGASSRAYANAVSNAVGQFLAGQGVLNAGNAGSLASSFANALSASAASVASSAAAQSASQSQAAASAFSRAASQSASQSAARSGAQSSSTTTTTSASGSQAASQSASSAAAQASASSFAQASSASLAASSAFSSAFSSANSLSAL

SEQ ID NO: 1170 - protein, 180 aa, Argiope bruennichi; identical to SEQ ID NO: 1167

SEQ ID NO: 1171 - protein, 180 aa, Argiope bruennichi
GSLASSFASALSASAASVASSAAAQSASQSQAAASAFSRAASQSASQSAARSGAQSSSTTTTTSASGSQAASQSASSAASQASASSFAQASSASLAASSSFSSAFSSANSLSALGNVAYQLGFNVANTLGIGNAPGLGAALSQAVSSVGVGASSSTYANVVSNAVGQFLAGQGVLNAANA

SEQ ID NO: 1172 - protein, 180 aa, Argiope bruennichi; identical to SEQ ID NO: 1171

SEQ ID NO: 1173 - protein, 180 aa, Argiope bruennichi; identical to SEQ ID NO: 1171

SEQ ID NO: 1174 - protein, 180 aa, Argiope bruennichi; identical to SEQ ID NO: 1171

SEQ ID NO: 1175 - protein, 180 aa, Argiope bruennichi; identical to SEQ ID NO: 1171

SEQ ID NO: 1176 - protein, 180 aa, Argiope bruennichi; identical to SEQ ID NO: 1171

SEQ ID NO: 1177 - protein, 180 aa, Argiope bruennichi
GSLASSFASALSASAASVASSAAAQSASQSQAAASAFSRAASQSGSQSAARSGAQSSSTTTTTSASGSQAASQSASSAASQASASSFAQASSASLAASSSFSSAFSSANSLSALGNVAYQLGFNVANTLGIGNAPGLGAALSQAVSSVGVGASSSTYANVVSNAVGQFLAGQGVLNAANA

SEQ ID NO: 1178 - protein, 180 aa, Argiope bruennichi; identical to SEQ ID NO: 1171

SEQ ID NO: 1179 - protein, 180 aa, Argiope bruennichi; identical to SEQ ID NO: 1171

SEQ ID NO: 1180 - protein, 180 aa, Argiope bruennichi
GSLASSFASALSASAASVASSAAAQSASQGQAAASAFSRAASQSASQSAARSGAQSSSTTTTTSASGSQAASQSASSAASQASASSFAQASSASLAASSSFSSAFSSANSLSALGNVAYQLGFNVANTLGIGNAPGLGAALSQAVSSVGVGASSSTYANVVSNAVGQFLAGQGVLNAANA

SEQ ID NO: 1181 - protein, 193 aa, Atypoides riversi; identical to SEQ ID NO: 1097

SEQ ID NO: 1182 - protein, 193 aa, Atypoides riversi; identical to SEQ ID NO: 1098

SEQ ID NO: 1183 - protein, 193 aa, Atypoides riversi; identical to SEQ ID NO: 1099

SEQ ID NO: 1184 - protein, 193 aa, Atypoides riversi; identical to SEQ ID NO: 1100

SEQ ID NO: 1185 - protein, 193 aa, Atypoides riversi; identical to SEQ ID NO: 1101

SEQ ID NO: 1186 - protein, 193 aa, Atypoides riversi; identical to SEQ ID NO: 1102

SEQ ID NO: 1187 - protein, 193 aa, Atypoides riversi; identical to SEQ ID NO: 1103

SEQ ID NO: 1188 - protein, 186 aa, Artificial Sequence
  Description of Artificial Sequence: Synthetic polypeptide
GSFASASAYAFAFASAFSQVLSNYGLLNINNAYSLASSIANAASASASSAAAAAASSSSAAAAAAAASGAAGSAAATSTTTSTSSSTAAAAASAAASAAASASGAARAAGASSAASDASASSSLQQSLGSALAQSSSFAAAFAQANSAASAAAIAYALAQIVANQIGFSSYSSAFASAASSAVSSL

SEQ ID NO: 1189 - protein, 186 aa, Avicularia juruensis
GSFASASAYAFAFASAFSQVLSNYGLLNISNAYSLASSIASAASASASSAAAAAASSSAAAAGAAAASGAAGSAASTSTTTSTSTSTAAAAASAAAAAAASASGAARAAGASSAASAASASSSLQQSLGSALAQSSSFAAAFAQANSAASAAAIAYALAQTVANQIGFSSYSSAFATAASSAVSSL

SEQ ID NO: 1190 - protein, 186 aa, Avicularia juruensis
GSFASASAYAFAFASAFSQVLSNYGLLNISNAYSLASSIANAASASASSAAAAAASSSSAAAGAAAASGAAGSVAATSTTTTASTSTAAAAASAAAAAAASASGAARAAGASSAASAASASSSLQQSLGSALAQSSSFAAAFAQANSAASAAAIAYALAQTVANQIGFSSYSSAFASAASSAVYSL

SEQ ID NO: 1191 - protein, 188 aa, Deinopis spinosa
GASASAYASAISNAVGPYLYGLGLFNQANAASFASSFASAVSSAVASASASAASSAYAQSAAAAQAQAASSAFSQAAAQSAAAAIAGASAGAGASAGAGASAGAGAVAASQAAASSSASAVASAFAQSASYALASSSAFASAFASATSAGYLGSLAYQLGLTTAYNLGLSNAQAFANTLSQAIVGVGV

SEQ ID NO: 1192 - protein, 199 aa, Deinopis spinosa
GASASAYASAISNAVGPYLYGLGLFNQANAASFASSFASAVSSAVASASASAASSAYAQSAAAQAQAASSAFSQAAAQSAAAASAGASAGAGASAGAGAVAGAGAVAGAGAVAGASAAAASQAAASSSASAVASAFAQSASYALASSSAFANAFASATSAGYLGSLAYQLGLTTAYNLGLSNAQAFASTLSQAVTGVGL

SEQ ID NO: 1193 - protein, 206 aa, Deinopis spinosa
GASASAYASAISNAVGPYLYGLGLFNQANAASFASSFASAVSSAVASASASAASSAYAQSAAAAQAQAASSAFSQAAAQSAAAASAGASAGAGASAGAGASAGAGASAGAGASAGAGAIAGAGAAATSLAAASSSASAVASAFAQSASSALASSSAFANAFASATSVSALNSIAYQMGVSAANILGISNAQGFANALSQAVGVVGV

SEQ ID NO: 1194 - protein, 184 aa, Latrodectus hesperus
GILTQENAAGLASSVSSGISSAASSVAAQAASAAQSSAFAQSQAAAQAFSQAASRSASQSAAQAGSSSTSTTTTTSQAASQAASQSASSSSSAASQSAFSQASSSALASSSSFSSAFSSASSASAVGQVGYQIGLNAAQTLGISNAPALADAVSQAVRTVGVGASPFQYANAVSNAFGQLLGGQ

SEQ ID NO: 1195 - protein, 184 aa, Latrodectus hesperus
GILTQENAAGLASSVSSAISSAASSVAAQAASAAQSSAFAQSQAAAQAFSQAASRSASQSAAQAGSSSTSTTTTTSQAASQAASQSASSSSSAASQSAFSQASSSALASSSSFSSAFSSASSASAVGQVGYQIGLNAAQTLGISNAPALADAVSQAVRTVGVGASPFQYANAVSNAFGQLLGGQ

SEQ ID NO: 1196 - protein, 184 aa, Latrodectus hesperus
GILTQENAAGLASSVSSAISSAASSVAAQAASAAQSSAFAQSQAAAQAFSQAASRSASQSAAQAGSSSTSTTTTTSQAASQAASQSASSSYSAASQSAFSQASSSALASSSSFSSAFSSASSASAVGQVGYQIGLNAAQTLGISNAPAFADAVSQAVRTVGVGASPFQYANAVSNAFGQLLGGQ

SEQ ID NO: 1197 - protein, 184 aa, Latrodectus hesperus; identical to SEQ ID NO: 1196

SEQ ID NO: 1198 - protein, 184 aa, Latrodectus hesperus
GILTQENAAGLASSVSSAISSAASSVAAQAASAAQSSAFAQSQAAAQALSQAASRSASQSAAQAGSSSTSTTTTTSQAASQAASQSASSSYSAASQSAFSQASSSALASSSSFSSAFSSASSASAVGQVGYQIGLNAAQTLGISSAPAFADAVSQAVRTVGVGASPFQYANAVSNAFGQLLGGQ

SEQ ID NO: 1199 - protein, 184 aa, Latrodectus hesperus
GILTQENAAGLASSVSSAISSAASSVASQAASAAQSSAFAQSQAAAQALSQAASRSASQSAAQAGSSSTSTTTTTSQAASQAASQSASSSYSAASQSAFSQASSSALASSSSFSSAFSSASSASAVGQVGYQIGLNAAQTLGISNAPAFADAVSQAVRTVGVGASPFQYANAVSNAFGQLLGEQ

SEQ ID NO: 1200 - protein, 171 aa, Nephila antipodiana
GVLNAGNASALAGSFARALSASAESQSFAQSQAYQQASAFQQAAAQSAAQSASRAGSTSSSTTTTTSGATSQAASQSASSSYSSAFAQAASSSLATSSAISRAFASVSSASAASSLAYNIGLSAARSLGIASDTALAGALAQAVGGVGAGASASAYANAIARAAGQFLATQ

SEQ ID NO: 1201 - protein, 171 aa, Nephila clavata
GIASDTALAGALAQAVAGVGAGASASTYANVIARAAGQFLATQGVLDAGNASALAGSFARALSASAESQSFAQSQAFQQASAFQQAASQSAGQSASRAGSTSSSTTTTTSAAASQAASQSASSSSSSAFAQAASSSLATSSAISRAFASVSSASAASSLAYTIGLSAARSL

SEQ ID NO: 1202 - protein, 171 aa, Nephila clavata; identical to SEQ ID NO: 1201

SEQ ID NO: 1203 - protein, 171 aa, Nephila clavata
GIASDTALAGALAQAVAGVGAGASASTYANVIARAAGQFLATQGVLDAGNASALAGSFARALLASAESQSFAQSQAFQQASAFQQAASQSAGQSASRSGSRSSSTTTTTSAAASQAESQSASSSSSSAFAQAASSSLATSSAISRAFASVSSASAASSLAYTIGLSAARSL

SEQ ID NO: 1204 - protein, 171 aa, Nephila clavata; identical to SEQ ID NO: 1201

SEQ ID NO: 1205 - protein, 171 aa, Nephila clavata; identical to SEQ ID NO: 1201

SEQ ID NO: 1206 - protein, 171 aa, Nephila clavata
GIASDTALAGALAQAVAGVGAGASASTYANVIARAAGQFLATQGVLDAGNASALAGSFARALSASAESQSFAQSQAFQQASAFQQAASQSAGQSASRAGSTSSSTTTTTSVAASQAASQSASSSSSSAFAQAASSSLATSSAISRAFASVSSASAASSLAYTIGLSAARSL

SEQ ID NO: 1207 - protein, 171 aa, Nephila clavata; identical to SEQ ID NO: 1201

SEQ ID NO: 1208 - protein, 171 aa, Nephila clavata; identical to SEQ ID NO: 1201

SEQ ID NO: 1209 - protein, 171 aa, Nephila clavipes
GDTAASYGNALSTAAGQFFATAGLLNAGNASALASSFARAFSASAESQSFAQSQAFQQASAFQQAASRSASQSAAEADSTSSSTTTTTSAARSQAASQSASSSYSSAFAQAASSSFAISSALSRAFSSVSSASAASSLAYSIGLSAARSLGIADATGLAGALARAVGALGQ

SEQ ID NO: 1210 - protein, 171 aa, Nephila clavipes
GATAASYGNALSTAAAQFFATAGLLNAGNASALASSFARAFSASAESQSFAQSQAFQQASAFQQAASRSASQSAAEAGSTSSSTTTTTSAARSQAASQSASSSYSSAFAQAASSSLATSSALSRAFSSVSSASAASSLAYSIGLSAARSLGIADAAGLAGVLARAAGALGQ

SEQ ID NO: 1211 - protein, 174 aa, Nephilengys cruentata
GQFLANQGILNTGNASSLASSFSSALSASAAAAQSQSFAQSQAAASAFQQAASQSASQSAAQSGSQSSSTTTTTSASGSQSASQSASSSSASASAFAQQSSASLAASSSFSQAFASAASASAVGNVAYQLGLSAAQSLGIANAGALASALAQSVSSVGVGASSSAYANAVAGAV

SEQ ID NO: 1212 - protein, 278 aa, Artificial Sequence
  Description of Artificial Sequence: Synthetic polypeptide
GSQAGSQAGSQAGSQAGSQAASQAGSQSASQASASSSASAFASASAFAQSASFALSSSSSFASAVSSASSVSALGTLGYQVGLQAAGSLGISNSQAFASSISQALTSVGVGASSSAYASAVSGVVAQYLSGTGVLTSANAQALASSFANVFAASAASASAAASASSAASAQSAAAALAQSQSAASAFSQAASQAFSQAASQAGSQAASQAGSQAASQAGSQAASQAGSQAASQAGSQAASQSGSGASSFTTTISRSSAGSQTGSQAGSQAGSQAGSQA

SEQ ID NO: 1213 - protein, 302 aa, Uloborus diversus
GSQAGSQAGSQAGSQAGSQAGSQAGSQAGSQAGSQAASQAGSQSASQASASSSASAFASASAFAQSASFALSSSSSFASAVSSASSISALGTLGYQVGLQAAGSLGISNSQAFASSISQALTSVGVGASSSAYASAVSGVVAQYLSGTGVLTSANAQALASSFANVFAASAASASAAASASSAASAQSTAAALAQSQSAASAFSQAASQAFSQAASQAGSQAASQAGSQAASQAGSQAASQAGSQAASQAGSQAASQAGSQAASQSGSGASSFTTTISRSSAGSQAGSQAGSQAGSQAGSQA

SEQ ID NO: 1214 - protein, 278 aa, Uloborus diversus; identical to SEQ ID NO: 1212

SEQ ID NO: 1215 - protein, 302 aa, Uloborus diversus
GSQAGSQAGSQAGSQAGSQAGSQAGSQAGSQAGSQAASQAGSQSASQASASSSASAFASASAFAQSASFALSSSSSFASAVSSASSISALGTLGYQVGLQAAGSLGISNSQAFASSISQALTSVGVGASSSAYASAVSGVVAQYLSGTGVLTSANAQALASSFANVFAASAASASAAASASSATSAQSAAAALAQSQAAASAFSQAASQASSQASSQASSQAASQASSQASSQAGSQASSQAASQAASQAASQAASQAASQSAASARAGASSASFSASQSNAASQAGSQAASRAGSQAASQA

SEQ ID NO: 1216 - protein, 143 aa, Araneus ventricosus
GGAGSAGGYGEGAGAGVRSGAGASAGAAGGYGRATGAGAGGAAAAGASGYGGSYGAGAGAGAAGAGGASAYGAGIGGGYGAGAADAYGGGASAGAGAGAGAGVSGGYGRAAGAGAAAAAGANGYGGSYDAGVGAGTAGAGAGA

SEQ ID NO: 1217 - protein, 152 aa, Araneus ventricosus
GASGGYGGGAGEGAGAAAAAGAGAGGAGGYGGGAGSGAGAVARAGAGGAGGYGSGIGGGYGSGAGAAAGAGAGGAGAYGGGYGTGAGAGARGADSAGAAAGYGGGVGTGTGSSAGYGRGAGAGAGAGAAAGSGAGAAGGYGGGYGAGAGAGA

SEQ ID NO: 1218 - protein, 132 aa, Araneus ventricosus
GAGGATGNRAGDAFAQVFSQNVINSGVITSTTVTKNSAQAAASSMVSTAAKSLGLDENTARSMANAMSSYAAAMAKSFRNSDEFIRNMSYQMGRMLSNAGAINESTASAAASSASSTVTETVRTYGPAAIFS

SEQ ID NO: 1219 - protein, 180 aa, Araneus ventricosus
GAGAGGAGGYAQGYGAGAGAGAGAGTGAGGAGGYGQGYGAGSGAGAGGAGGYGAGAGAGAGAGGASGYGQGYGDGAGAGAGAAAAAGAAAGARGAGGYGGGAGDGAGAGAGAGAAGGYGQGYGAGEGAGAGAGAGGAGGYGAGAGAGGAGGYGQSYGDGAAAAAGSGAGAGGSGGYGAGA

SEQ ID NO: 1220 - protein, 182 aa, Araneus ventricosus
GAGAGAGAGSGAGAAGGYGGGAGAGVGAGGAGGYDQGYGAGAGAGSGAGAGGAGGYGGGAGAGADAGAGGAGGYGGGAGAGAGARAGAGGVGGYGQSYGAGAGAGAGVGAGGAGAGGADGYGQGYGAGAGTGAGDAGGYGGGAGAGASAGAGGYGGGAGAGGVGVYGKGYGSGSGAGAAAAA

SEQ ID NO: 1221 - protein, 132 aa, Araneus ventricosus; identical to SEQ ID NO: 1218

SEQ ID NO: 1222 - protein, 216 aa, Araneus ventricosus
GAGAGGAGGYAQGYGAGAGAGAGAGTGAGGAGGYGQGYGAGSGAGAGGAGGYGAGAGAGAGAGDASGYGQGYGDGAGAGAGAAAAAGAAAGARGAGGYGGGAGAGAGAGAGAAGGYGQGYGAGAGEGAGAGAGAGAVAGAGAAAAAGAGAGAGGAEGYGAGAGAGGAGGYGQSYGDGAAAAAGSGAGAGGSGGYGAGAGAGSGAGAAGGYGGGAGA

SEQ ID NO: 1223 - protein, 214 aa, Araneus ventricosus
GVGAGGEGGYDQGYGAGAGAGSGGGAGGAGGYGGGAGAGSGGGAGGAGGYGGGAGAGAGAGAGGAGGYGGGAGAGTGARAGAGGVGGYGQSYGAGASAAAGAGVGAGGAGAGGAGGYGQGYGAGAGIGAGDAGGYGGGAGAGASAGAGGYGGGAGAGAGGVGGYGKGYGAGSGAGAAAAAGAGAGSAGGYGRGDGAGAGGASGYGQGYGAGAAA

SEQ ID NO: 1224 - protein, 233 aa, Argiope argentata
GAGRGYGGGYGGGAAAGAGAGAGAGRGYGGGYGGGAGSGAGSGAGAGGGSGYGRGAGAGAGAGAAAAAGAGAGGAGGYGGGAGAGAGASAAAGAGAGAGGAGGYGGGYGGGAGAGAGAGAAAAAGAGAGAGAGRGYGGGFGGGAGSGAGAGAGAGGGSGYGRGAGGYGGGYGGGAGTGAGAAAATGAGAGAGAGRGYGGGYGGGAGAGAGAGAGAGGGSGYGRGAGAGASVAA

SEQ ID NO: 1225 - protein, 143 aa, Deinopis spinosa
GGQGDQGYRVQGGYGPVSNAAASAAAAASAGGGQGAGQGGYGPSSGAAAASAAGDSGGRGGRQGYVGGAGAGAGSGAGGQGGQGQYGPGTNGAAAAAAASAASAGGSGSQVSQDVDQGYGGGAGLGGSGSGSGAAAAAAAAAA

SEQ ID NO: 1226 - protein, 149 aa, Latrodectus hesperus
GGGYGRGQGAGAGVGAGAGAAAGAAAIARAGGYGQGAGGYGQGQGAGAAAGAAAGAGAGGYGQGAGGYGRGQGAGAGAGAGAGARGYGQGAGAGAAAGAAASAGAGGYGQGAGGYGQGQGAGAAAGAAASAGAGGYGQGAGGYGQGQGA

SEQ ID NO: 1227 - protein, 148 aa, Latrodectus hesperus
GAGAGAGAGAGGYGQGSGAGAAAGAAASAGAGGYGQGAGGYGRGQGASAGAGAGAGTGGYGQGAGAGAAAGAAASAGAGGYGQGAGGYGQGTGAGAGGYGQGTGAGAAAGAGASAGARGYGQRAGGYGQGQGAGAAAGAAAGAGRYGQ

SEQ ID NO: 1228 - protein, 200 aa, Metepeira grandiosa
GAGYGAGAGAGAGYGAGAGAGAGAGAVAAGGAGAGAGRGYGAGAGAGAGAAGGAGAGAGAGYGAGAGRGYGAGSGAGAGAGAAGGAGAGAGAGYGAGAGAGAGAASGAGAGAGYGAGAGRGYGAGAGAGSGAGAGAGAAGGAGAGYGAGAGAGAGSGAAAAGGAGAGAGYGAGAGRGYGAGAGAGSGAGAGAGEAGGAGA

SEQ ID NO: 1229 - protein, 212 aa, Metepeira grandiosa
GYGAGAGRGYGAGAGAGAGAVAASGAGAGAGYGAGAGAGAGAGYGAGAGRGYGAGAGAGAGSGAASGAGAGAGYGAGAGAGAGYGAGAGSGYGTGAGAGAGAAAAGGAGAGAGYGAGAGRGYGAGAGAGAASGAGAGAGAGAASGAGAGSGYGAGAAAAGGAGAGAGGGYGAGAGRGYGAGAGAGAGAGSGSGSAAGYGQGYGSGSGAGAAA

SEQ ID NO: 1230 - protein, 206 aa, Nephila antipodiana
GAAASGAGAGGAGGYGRGAGAGAGAGAGSAAGNAFAQSLSSNLLSSGDFVQMISSTTSTDQAVSVATSVAQNVGNQLGLDANAMNSLLGAVSGYVSTLGNAISDASAYANAISSAIGNVLANSGSISESTASSAASSAASSVTTTLTSYGPAVFYAPTSSAGGYGGLVGYGAGAGAAAGAGAGAGGAGGYIGQGGYGAGAGAAAAA

SEQ ID NO: 1231 - protein, 145 aa, Nephila clavipes
GGYGAGAGAVAAAGAAGAGGYGRGAGGYGGQGGYGAGAGAGAAAAAGAGAGGAGGYGRGAGAGAGAAAGAGAGAGGAGYGGQGGYGAGAGAGAAAAAGAGAGGAGGYGRGAGAGAGAAAGAGAGGYGGQGGYGAGAGAGAAAAAA

SEQ ID NO: 1232 - protein, 150 aa, Nephila clavipes
GAGSGGAGGYGRGAGAGAGAAAGAGAGAGSYGGQGGYGAGAGAGAAAAAGAGAGAGGYGRGAGAGAGAGAGAAARAGAGAGGAGYGGQGGYGAGAGAGAAAAAGAGAGGAGGYGRGAGAGAGAAAGAGAGAGGYGGQSGYGAGAGAAAAA

SEQ ID NO: 1233 - protein, 153 aa, Nephila clavipes
GAGAGGAGGYGRGAGAGAGAAAGAGAGAAAGAGAGGYGGQGGYGAGAGAGAAAAAGAGAGGAGGYGRGAGAGAGVAAGAGAGGYGGQGGYGAGAGAGAAAAAATGAGGAGGYGRGAGAGAGAAAGAGAGTGGAGYGGQGGYGAGAGAGAAAAA

SEQ ID NO: 1234 - protein, 161 aa, Nephila clavipes
GAGAGGAGYGRGAGAGAGAAAGAGAGAAAGAGAGAGGYGGQGGYGAGAGAGAAAAAGAGAGGAAGYSRGGRAGAAGAGAGAAAGAGAGAGGYGGQGGYGAGAGAGAAAAAGAGSGGAGGYGRGAGAGAAAGAGAAAGAGAGAGGYGGQGGYGAGAGAAAAA

SEQ ID NO: 1235 - protein, 179 aa, Nephilengys cruentata
GYGAGAGAGAGTGGAGGYGRGVGAGAGAGAGAGGAGGYGGGQNYGAGAGAAAAAGAGAGAGGAGGYGRGAGAGAGAAAGAGAGAAAGAGAGGAGGYGTGQGYGEGAGAGAGVGAGGAGGYGRGAGAGAGAGAGGYGAGQGYGAGAGAGAAAAAGAGAGAGGAGGYGRGAGAGAGAGAAA

SEQ ID NO: 1236 - protein, 164 aa, Nephilengys cruentata
GAGAGGAGGYGAGQGYGAGAGAGAAAGAGAGGARGYGARQGYGSGAGAGAGARAGGAGGYGRGAGAGAAAASGAGAGGYGAGQGYGAGAGAVASAAAGAGSGAGGAGGYGRGAGAVAGAGAGGAGGYGAGAGAAAGVGAGGSGGYGGRQGGYSAGAGAGAAAAA

SEQ ID NO: 1237 - protein, 182 aa, Nephilengys cruentata
GGAGGYGVGQGYGAGAGAGAAAGAGAGGAGGYGAGQGYGAGAGVGAAAAAGAGAGVGGAGGYGRGAGAGAGAGAGAAAGAGAGAAAGAGAGGAGGYGAGQGYGAGAGVGAAAAAGAGAGVGGAGGYGRGAGAGAGAGAGGAGGYGRGAGAGAGAGAGAGGAGGYGAGQGYGAGAGAGAAAAA

SEQ ID NO: 1238 - protein, 200 aa, Nephilengys cruentata
GAGAGAGGAGGYGRGAGAGAGAGAGAGGAGGYGAGQGYGAGAGAGAAAAAGAGAGAGGAGGYGRGAGAGAGAGAGAGGAGGYGAGQGYGAGAGAGAAAAAGAGAGAGGAGGYGRGAGAGAGAGAGAGGAGGYGRGAGAGAGAGAAAGAGAGGAGRYGAGQGYGAGAGAGAAAGAGAGGAGGYGAGQGYGAGAGAGAAAAA

SEQ ID NO: 1239 - protein, 186 aa, Nephilengys cruentata
GAGAGVGGAGGYGSGAGAGAGAGAGAASGAAAGAAAGAGAGGAGGYGTGQGYGAGAGAGAGAGAGGAGGYGRGAGAGAGAGAGGAGGYGAGQGYGAGAGAGAAAAAGDGAGAGGAGGYGRGAGAGAGAGAAAGAGAGGAGGYGAGQGYGAGAGAGAAAGAGAGGAGGYGAGQGYGAGAGAGAAAAA

SEQ ID NO: 1240 - protein, 182 aa, Nephilengys cruentata
GAGAGVGGAGGYGRGAGAGAGAAAGAGAGAAAGAGAGGAGGYGTGQGYGAGAGAGAGAGGAGGYGRGAGAGAGAGAGAGGAGEYGAGQGYGAGAGAGAAAAAGAGAGAGGAGGYGRGAGAGAGAGAAAGAGAGGAGGYGARQGYGAGAGAGAAAGAGAGGAGGYGAGQGYGAGAGAGAAAAA

SEQ ID NO: 1241 - protein, 160 aa, Nephilengys cruentata
GAGAGAGGAGGYGRGAGAGAGAGAGAAAGQGYGSGAGAGAGASAGGAGSYGRGAGAGAAAASGAGAGGYGAGQGYGAGAGAVASAAAGAGSGAGGAGGYGRGAVAGSGAGAGAGAGGAGGYGAGAGAGAAAGAVAGGSGGYGGRQGGYSAGAGAGAAAAA

SEQ ID NO: 1242 - protein, 192 aa, Nephilengys cruentata
GAGAGAGGAGGFGRGAGAGAGAGAGAAAGAGAGGAGGYGAGQGYGAGAGAGAAAAAGAGAGAGGAGGYGRGAGAGAGAGAAAAAGAGAGGAGGYGAGQGYGAGAGAGAAAAAGAGAGTGGAGGYGAGQGYGAGAGAGAGAGAGAGAGGAGGYGRGAGAGAGAGAGAGGAGGYGVGQGYGAGAGAGAGAGSAA

SEQ ID NO: 1243 - protein, 128 aa, Nephilengys cruentata
GNAFAQSLSSNLLSSGDFVQMISTTTSTDQAVSVATSVAQNVGNQLGLDANAMNNLLAAVGGYVSSLGGAVADAAAYANAISSAIGNVLANTGSINESTASSAASSAASSVTTTLTSYGPAVFYGRGA

SEQ ID NO: 1244 - protein, 145 aa, Parawixia bistriata
GAGAGGGYGGGYGAGGGAGAGAGAGAGAGAGAGAGRGGAGGYGAGAGAGAGAAAAAAAGAGAGGGYGGGYGAGVGAGAGAGAGAGGGYGGGYGAGAGAGAGAAAAAAAGAGAGGGYGGGYGAGGGAGAGAGAGAGAGAGAGAGRG

SEQ ID NO: 1245 - protein, 147 aa, Parawixia bistriata
GAVGYGAGAGAGAAAAAAAGAGAGGGYGGGYGAGGGAGAGAGAGAGGGYGGGYGAGGGAGAGAGAGAGAGRGGAGGYGAGAGAAAGAAAAAAAGAGAGGGYGGGYGAGGGAGAGAGAAAGAGAGAGRGGAGGYGAGAGAGAGAAAAA

SEQ ID NO: 1246 - protein, 132 aa, Uloborus diversus
GSGAGAGSGYGAGAGAGAGSGYGAGSSASAGSAINTQTVTSSTTTSSQSSAAATGAGYGTGAGTGASAGAAASGAGAGYGGQAGYGQGAGASARAAGSGYGAGAGAAAAAGSGYGAGAGAGAGSGYGAGAAA

SEQ ID NO: 1247 - protein, 174 aa, Uloborus diversus
GSGYGAGAGAGAGSGYGAGAGAGSGYGAGAGAGAGSGYVAGAGAGAGAGSGYGAGAGAGAGSSYSAGAGAGAGSGYGAGSSASAGSAVSTQTVSSSATTSSQSAAAATGAAYGTRASTGSGASAGAAASGAGAGYGGQAGYGQGGGAAAYRAGAGSQAAYGQGASGSSGAAAAA

SEQ ID NO: 1248 - protein, 168 aa, Uloborus diversus
GAGAGYGGQVGYGQGAGASAGAAAAGAGAGYGGQAGYGQGAGGSAGAAAAGAGAGRQAGYGQGAGASARAAAAGAGTGYGQGAGASAGAAAAGAGAGSQVGYGQGAGASSGAAAAAGAGAGYGGQVGYEQGAGASAGAEAAASSAGAGYGGQAGYGQGAGASAGAAAA

SEQ ID NO: 1249 - protein, 198 aa, Uloborus diversus
GAGAGYRGQAGYIQGAGASAGAAAAGAGVGYGGQAGYGQGAGASAGAAAAAGAGAGRQAGYGQGAGASAGAAAAGAGAGRQAGYGQGAGASAGAAAAGADAGYGGQAGYGQGAGASAGAAASGAGAGYGGQAGYGQGAGASAGAAAAGAGAGYLGQAGYGQGAGASAGAAAGAGAGYGGQAGYGQGTGAAASAAASSA

SEQ ID NO: 1250 - protein, 179 aa, Araneus ventricosus
GGPGGPGGPGGAYGPGAGGPSGPGGAGPGGVGPYGPGGVGPGGVGPGGAGVGPGGAPGAPGGPGGPGGPGGPGGVGGPLGAGAGGVGPGGAGAYGPGGAGAYGPGGVGLGGAGAYGPGGAGPGGAGPHGPGGPGGAGPGGEGPVTVDVEVSVGGAPGGGSGGVGPGGAGVGPGGAPGAP

SEQ ID NO: 1251 - protein, 268 aa, Artificial Sequence
  Description of Artificial Sequence: Synthetic polypeptide
GGAPGGGPGGAGPGGAGFGPGGGAGFGPGGGAGFGPGGAAGGPGGPGGPGGPGGAGGYGPGGAGGYGPGGVGPGGAGGYGPGGAGGYGPGGSGPGGAGPGGAGGEGPVTVDVDVTVGPEGVGGGPGGAGPGGAGFGPGGGAGFGPGGAPGAPGGPGGPGGPGGPGGPGGVGPGGAGGYGPGGAGGVGPAGTGGFGPGGAGGFGPGGAGGFGPGGAGGFGPGGAGGYGPGGVGPGGAGGFGPGGVGPGGSGPGGAGGEGPVTVDVDVSV

SEQ ID NO: 1252 - protein, 268 aa, Argiope trifasciata
GGAPGGGPGGAGPGGAGFGPGGGAGFGPGGGAGFGPGGAAGGPGGPGGPGGPGGAGGYGPGGAGGYGPGGVGPGGAGGYGPGGAGGYGPGGSGPGGAGPGGAGGEGPVTVDVDVTVGPEGVGGGPGGAGPGGAGFGPGGGAGFGPGGAPGAPGGPGGPGGPGGPGGPGGVGPGGAGGYGPGGAGGVGPAGTGGFGPGGAGGFGPGGAGGFGPGGAGGFGPAGAGGYGPGGVGPGGAGGFGPGGVGPGGSGPGGAGGEGPVTVDVDVSV

SEQ ID NO: 1253 - protein, 268 aa, Argiope trifasciata
GGAPGGGPGGAGPGGAGFGPGGGAGFGPGGGAGFGPGGAAGGPGGPGGPGGPGGAGGYGPGGAGGYGPGGVGPGGAGGYGPGGAGGYGPGGSGPGGAGPGGAGGEGPVTVDVDVTVGPEGVGGGPGGAGPGGAGFGPGGGAGFGPGGAPGAPGGPGGPGGPGGPGGPGGVGPGGAGGYGPGGAGGFGPGGTGGFGPGGAGGFGPGGAGGFGPGGAGGFGPGGAGGYGPGGVGPGGAGGFGPGGVGPGGSGPGGAGGEGPVTVDVDVSV

SEQ ID NO: 1254 - protein, 190 aa, Nephila clavipes
GVSYGPGGAGGPYGPGGPYGPGGEGPGGAGGPYGPGGVGPGGSGPGGYGPGGAGPGGYGPGGSGPGGYGPGGSGPGGYGPGGSGPGGYGPGGSGPGGYGPGGYGPGGSGPGGSGPGGSGPGGYGPGGTGPGGSGPGGYGPGGSGPGGSGPGGYGPGGSGPGGFGPGGSGPGGYGPGGSGPGGAGPGGVGP

SEQ ID NO: 1255 - protein, 230 aa, Nephila clavipes
GGFGPGGAGPGGAAPGGAGPGGAGPGGAGPGGAGPGGAGPGGAGPGGAGGAGGAGGSGGAGGSGGTTIIEDLDITIDGADGPITISEELPISGAGGSGPGGAGPGGVGPGGSGPGGVGPGGSGPGGVGPGGSGPGGVGPGGAGGPYGPGGSGPGGAGGAGGPGGAYGPGGSYGPGGSGGPGGAGGPYGPGGEGPGGAGGPYGPGGAGGPYGPGGAGGPYGPGGEGGPYGP

SEQ ID NO: 1256 - protein, 210 aa, Nephila clavipes
GGSYGPGGAGGPYGPGGPYGPGGEGPGGAGGPYGPGGVGPGGGGPGGYGPGGAGPGGYGPGGSGPGGYGPGGSGPGGYGPGGSGPGGYGPGGSGPGGYGPGGSGPGGSGPGGYGPGGSGPGGSGPGGYGPGGSGPGGYGPGGSGPGGSGPGGYGPGGSGPGGSGPGGYGPGGSGPGGFGPGGFGPGGSGPGGYGPGGSGPGGAGPGGVGP

SEQ ID NO: 1257 - protein, 233 aa, Nephila clavipes
GGFGPGGAGPGGAGPGGAGPGGAGPGGAGPGGAGPGGAGPGGAGPGGAGGAGGAGGAGGSGGAGGSGGTTIIEDLDITIDGADGPITISEELTISGAGGSGPGGAGPGGVGPGGSGPGGVGPGGSGPGGVGPGGSGPGGVGPGGAGGPYGPGGSGPGGAGGAGGPGGAYGPGGSYGPGGSGGPGGAGGPYGPGGEGPGGAGGPYGPGGAGGPYGPGGAGGPYGPGGEGGPYGP

SEQ ID NO: 1258 - protein, 180 aa, Nephila clavipes
GGSYGPGGAGGPYGPGGPYGPGGEGPGGAGGPYGPGGVGPGGGGPGGYGPGGAGPGGYGPGGSGPGGYGPGGSGPGGYGPGGSGPGGYGPGGSGPGGYGPGGSGPGGSGPGGYGPGGSGPGGYGPGGSGPGGSGPGGYGPGGSGPGGFGPGGFGPGGSGPGGYGPGGSGPGGAGPGGVGP

SEQ ID NO: 1259 - protein, 233 aa, Nephila clavipes
GGFGPGGAGPGGAGPGGAGPGGAGPGGAGPGGAGPGGAGPGGAGPGGAGGAGGAGGAGGSGGAGGSGGTTIIEDLDITIDGADGPITISEELTISGAGGSGPGGAGPGGVGPGGSGPGGVGPGGSGPGGVGPGGSGAGGVGPGGAGGPYGPGGSGPGGAGGAGGPGGAYGPGGSYGPGGSGGPGGAGGPYGPGGEGPGGAGGPYGPGGAGGPYGPGGAGGPYGPGGEGGPYGP

SEQ ID NO: 1260 - protein, 285 aa, Nephilengys cruentata
GAGGSGPGGAGPGGAGPGGAGPGGAGPGGAGPGGVGPGGAGGPGGAGGPFGPGGSGPGGAGGAGGPYGPGGAYGPGGPGGPGGPGGPGSGGPYGPGGAYGPGGAYGPGGAYGPGGAGGPGGAGGPYGPGGPYGPGGPYGPGGAGGPGGAGGPYGPGGAGPGGYGPGGAGPGGYGPGGSGPGGAGPGGYGPGGSGPGGAGPGGYGPGGAGPGGYGPGGAGPGGAGPGGAGPGGYGPGGSGPGGPGSGGPGGAGGSGGTTVIEDLDITVNGPGGPITISEELTVGGP

SEQ ID NO: 1261 - protein, 269 aa, Nephilengys cruentata
GAGGSGPGGAGPGGAGPGGAGPGGVGPGGAGGPGGAGGPFGPGGSGPGGAGGAGGPYGPGGAYGPGGPGGPGGPGGPGSGGPYGPGGAYGPGGAYGPGGAYGPGGAGGPYGPGGPYGPGGPYGPGGAGGPGGAGGPYGPGGAGPGGYGPGGAGPGGYGPGGSGPGGAGPGGYGPGGSGPGGAGPGGYGPGGAGPGGYGPGGAGPGGAGPGGAGPGGYGPGGSGPGGPGSGGPGGAGGSGGTTVIEDLDITVNGPGGPITISEELTVGGP

SEQ ID NO: 1262 - protein, 288 aa, Nephilengys cruentata
GAGGSGPGGAGPGGAGPGGAGPGGAGPGGAGPGGVGPGGAGGPGGAGGPFGPGGSGPGGAGGAGGPYGPGGAYGPGGPGGPGGPGGPGGPGSGGPYGPGGAYGPGGAYGPGGAYGPGGAGGPGGAAGPYGPGGPYGPGGPYGPGGAGGPGGAGGPYGPGGAGPGGYGPGGAGPGGYGPGGSGPGGAGPGGYGPGGSGPGGAGPGGYGPGGAGPGGYGPGGAGPGGAGPGGAGPGGYGPGGSGPGGPGSGGPGGAGGSGGTTVIEDLDITLNGPGGPITISEELTVGGP

SEQ ID NO: 1263 - protein, 177 aa, Nephila madagascariensis
GAGGSGPGGAGPGGVGPGRSGPGGVGPGGSGPGSVGPGGSGQGGLGIGRSGPGGVGPGGSGPGSIGPGGSGQGGLGPGGSGQGGLGPGGSGPGGVGSGGVGGPYGPGGSGPGGVGGAGGPYGPGGSGGPGGAGGPYGPGGPYGPGGAGGPYGPGGAGGPYGPGGPYGPGGAGGPGGG

SEQ ID NO: 1264 - protein, 191 aa, Nephila madagascariensis
GPGGAGGPYGPGGPGGAGPGGYGPGGYGPGGAGPGGAGPGGYGPGGAGPGGYGPGGAGPGGSGPGGIGPGGSGPGGYGPGGIGPGGTGPGGAGPGGAGPGGAGPSGAGPGGAGPSGAGRGGSGRGSVGRGGAGRGGAGRGGAGGAGGSGGAGGSGGAGGSGGTTIIEDLDITVDGANGPITISEELTIGGA

SEQ ID NO: 1265 - protein, 195 aa, Nephila madagascariensis
GAGGVGPGGSGPGGVGPGGSGPGGVGPGGSGPGGVGSGGSGPGGVGPGGSGPGGVGSGGFGPGGIGPGGSGPGGVGPGGVGGPYGPGGSGPGGAGGAGGSYGPGGPYGPGGSGGPGGAGGPYGPGGAGGPYGPGGPYGPGGAGGPGGEGPGGAGGPYGPGGPGGAGPGGYGPGGAGPGGYGPGGAGPGGYGPGGA

SEQ ID NO: 1266 - protein, 216 aa, Nephila madagascariensis
GSGGYGPGGAGPGGYGPGGPGPGGYGPGGAGPGGYGPGGTGPGGSAPGGAGPGGAGPGGYGPGGSGPGGYGPGGGPGGAGPGGAGPGGAGPGGAGPGGAGPGGAGPGGAGPGGAGPGGAGPGGAGPGGVGTGGLGRGGAGRGGAGRGGAGRGGAGRGGAGRGGTGGVGGAGGAGGAGGVGGAGGSGGTTVIEDLDITIDGADGPITISEELTISGA

SEQ ID NO: 1267 - protein, 198 aa, Nephila madagascariensis
GAGGSGPGGAGPGGVGPGGSGPGGVGPGGSGPGGVGPGGAGGPYRPGGSGPGGAGGAGGPGGAYGPGGSGGPGGAGGPYGPGGEGPGGSGGPYGPGGEGPGGAGGPYGPGGAGGPYGPGGAGGPYGPGGAGGPYGPGGAGGPYGPGGAGGPYGPGGAGGPYGPGGEGPGGAGGPYGPGGVGPGGTGPGGYGPGGAGPG

SEQ ID NO: 1268 - protein, 208 aa, Nephila madagascariensis
GYGPGGSGPGGYGPGGSGPGGFGPGGSGPGGYGPGGSGPGGYGPGGSGPGGAGPGGYGPGGTGPGGSGPGGYGPGGSGPGGYGPGGSGPGGYGPGGSGPGGAGPGGAGPGGAGPGGAGPGGVGPGGAGPGGSGPGGAGPGGAGRGGAGRGGAGPGGAGPGGAGGAGGAGGSGGAGGSGGTTVIEDLDITIDGADGPITISEELTINGA

SEQ ID NO: 1269 - protein, 183 aa, Nephila madagascariensis
GAGGSGPGGAGPGGVGPGGSGPGGVGPGGSGPGGVGPGGAGGPYGPGGSGPGGAGGAGGPGGAYGPGGSGGPGGAGGPYGPGGEGPGGAGGPYGPGGEGPGGAGGPYGPGGAGGPYGPGGAGGPYGPGGAGGPYGPGGAGGPYGPGGVGPGGTGPGGYGPGGAGPGGYGPGGSGPGGYGPGGS

SEQ ID NO: 1270 - protein, 201 aa, Nephila madagascariensis
GPGGYGPGGSGPGGFGPGGSGPGGSGPGGSGPGGYGPGGSGPGGYGPGGSGPGGYGPGGSGPGGYGPGGSGPGGSGPGGYGPGGSGPGGYGPGGSGPGGAGPGGAGPGGVGPGGAGPGGAGPGGVGPGGAGPGGAGPGGAGPGGAGRGGAGPGGAGGAGGAGGSGGAGGSGGTTVIEDLDITIDGADGPITISEELTIGGA

SEQ ID NO: 1271 - protein, 208 aa, Latrodectus hesperus
GINVDSDIGSVTSLILSGSTLQMTIPAGGDDLSGGYPGGFPAGAQPSGGAPVDFGGPSAGGDVAAKLARSLASTLASSGVFRAAFNSRVSTPVAVQFTDALVQKIASNLGLDYATASKLRKASQAVSKVRMGSDTNAYALAISSALAEVLSSSGKVADANINQIAPQLASGIVLGVSTTAPQFGVDLSSINVNLDISNVARNMQASIQ

SEQ ID NO: 1272 - protein, 168 aa, Latrodectus hesperus
GGPAPITAEGPDFGAGYPGGAPTDLSGLDMGAPSDGSRGGDATAKLLQALVPALLKSDVFRAIYKRGTRKQVVQYVTNSALQQAASSLGLDASTISQLQTKATQALSSVSADSDSTAYAKAFGLAIAQVLGTSGQVNDANVNQIGAKLATGILRGSSAVAPRLGIDLS

SEQ ID NO: 1273 - protein, 208 aa, Latrodectus hesperus
GINVDSDIGSVTSLILSGSTLQMTIPAGGDDLSGGYPGGFPAGAQPSGGAPVDFGGPSAGGDVAAKLARSLASTLASSGVFRAAFNSRVSTPVAVQLTDALVQKIASNLGLDYATASKLRKASQAVSKVRMGSDTNAYALAISSALAEVLSSSGKVADANINQIAPQLASGIVLGVSTTAPQFGVDLSSINVNLDISNVARNMQASIQ

SEQ ID NO: 1274 - protein, 168 aa, Latrodectus hesperus; identical to SEQ ID NO: 1272

SEQ ID NO: 1275 - protein, 208 aa, Latrodectus hesperus
GINVDSDIGSVTSLILSGSTLQMTIPAGGDDLSGGYPGGLPSGAQPSGGAPVDFGGPSAGGDVAAKLARSLASTLASSGVFRAAFNSRVSTPVAVQLTDALVQKIASNLGLDYATASKLRKASQAVSKVRMGSDTNAYALAISSALAEVLSSSGKVADANINQIAPQLASGIVLGVSTTAPQFGVDLSSINVNLDISNVARNMQASIQ

SEQ ID NO: 1276 - protein, 168 aa, Latrodectus hesperus; identical to SEQ ID NO: 1272

SEQ ID NO: 1277 - protein, 208 aa, Latrodectus hesperus; identical to SEQ ID NO: 1273

SEQ ID NO: 1278 - protein, 168 aa, Latrodectus hesperus; identical to SEQ ID NO: 1272

SEQ ID NO: 1279 - protein, 208 aa, Latrodectus hesperus
GINVDSDIGSVTSLILSGSTLQMTIPAGGDDLSGGYPGGFPSGAQPSGGAPVDFGGPSAGGDVAAKLARSLASTLASSGVFRAAFNSRVSTPVAVQLTDALVQKIASNLGLDYATASKLRKASQAVSKVRMGSDTNAYALAISSALAEVLLSSGKVADANINQIAPQLASGIVLGVSTAAPQFGVDLSSINVNLDISNVARNMQASIQ

SEQ ID NO: 1280 - protein, 168 aa, Latrodectus hesperus; identical to SEQ ID NO: 1272

SEQ ID NO: 1281 - protein, 215 aa, Argiope amoena
GSSAGLVSRVANALANTSTLRAVLRRGVSQQTASSVVQRAVQSLAGTLGVDGNSLSRIALQAISQLPGGSDTSAYAQAFSSALFNAGVLNASNIDTLGSRVLSAVLNGVSSAAQGIGLNVDTGSVQSDISSSSSFLSSSSSSASFSQTSASSTSGAGYTAPAGPSGYTGPSGPSGYTGPVGGAAQFGSVSGQTSFGQTSGFTASTGGQAAFGATS

SEQ ID NO: 1282 - protein, 215 aa, Argiope amoena
GSSAGLVSRVANALANTSTLRAVLRRGVSQQTASSVVQRAVQSLAGTLGVDGNSLSRIALQAISQLPAGSDTSAYAQAFSSALVNAGVLNASNIDTLGSRVLSAVLNGVSSAAQGIGLNVDTGSVQSDISSSSSFLSSSSSSASFSQTSASSTSGAGYTGPSGPSGYTGPAGPSGYTGPVGGAAQFGSVSGQTSFGQTSGFTASTGGQAAFGATS

SEQ ID NO: 1283 - protein, 215 aa, Argiope amoena
GSSAGLVSRVANALANTSTLRAVLRRGVSPQTASSVVQRAVQSLAGTLGVDGNSLSRIALQAISQLPAGSDTSAYAQAFSSALVNAGVLSASNIDTLGSRVLSAVLNGVSSAAQGIGLNVDTGSVQSDISSSSSFLSSSSSSSSISQTSASSTSGAGYTGPAGPSGYTGPSGPSGYTGPVGGAAQFGSVSGQTSFGQTSGFTASTGGQAAFGATS

SEQ ID NO: 1284 - protein, 215 aa, Argiope amoena
GSSAGLVSRVANALANTSTLRAVLRRGVSQQTASSVVQRAVQSLAGTLGVDGNSLSRIALQAISQLPAGSDTSAYAQAFSSALVNAGVLNASNIDTLGSRVLSAVLNGVSSAAQGIGLNVDSGSIQSDISSSSSFLSSSSSSSSISQTSASSTSGAGYTGPAGPSGYTGPSGPSGYTGPVGGAAQFGSVSGQTSFGQTSGFTASTGGQAAFGATS

SEQ ID NO: 1285 - protein, 203 aa, Araneus ventricosus
GGGVGSLTGQTSFGQTSGFTSTAGAQGGFGPTTGAQSALISRIANALANTSTLRSVLRTGVSQQTASSVVQRTIQTLASNLGIDGNNLSRIALQAISQVPAGSDTSAYAQAFSTALVTGGVLNANNVDTLGSQVLSAVLNGVSSAAQGLGINVDTGSVQSDIRSSSSSLSTSSSSASFSQTSGAASTTGFTGAGGYPGGAGPL

SEQ ID NO: 1286 - protein, 203 aa, Araneus ventricosus
GGGVGSLTGQTSFGQTSGFTSTAGAQGGFGPTTGAQSALISRIANALANTSTLRSVLRTGVSQQTASSVVQRAIQTLASNLGIDGNNLSRIALQAISQVPAGSDTSAYAQAFSTALVTGGVLNANNVDTLGSQVLSAVLNGVSSAAQGLGINVDTGSVQSDIRSSSSSLSTSSSSASFSQTSGAASTTGFTGAGGYPGGAGPL

SEQ ID NO: 1287 - protein, 203 aa, Araneus ventricosus; identical to SEQ ID NO: 1285

SEQ ID NO: 1288 - protein, 203 aa, Araneus ventricosus
GGGVGSLTGQTSFGQTSGFTSTAGAQGGFGPTTGAQSALISRIANALANTSTLRSVLRTGVSQQTASSVVQRAIQTLASNLGLDGNNLSRIALQAISQVPAGFDASAYAQAFSTALVTGGVLNANNVDTLGSQVLSAVLNGVSSAAQGLGINVDTGSVQSDIRSSSSSLSTSSSSASFSQTSGAASTTGFTGAGGYPGGAGPL

SEQ ID NO: 1289 - protein, 203 aa, Araneus ventricosus
GGGVGSLTGQTSFGQTSGFTSTAGAQGGFGPTTGAQSALISRIANALANTSTLRSVLRTGVSQQTASSVVQRTIQTLASNLGIDGNNLSRIALQAISQVPAGSDTSAYAQAFSTALVTGGVLNANNVDTLGSQVLSAVLSGVSSAAQGLGINVDTGSVQSDIRSSSSSLSTSSSSASFSQTSGAASTTGFTGAGGYPGGAGPL

SEQ ID NO: 1290 - protein, 203 aa, Araneus ventricosus
GGGVGSLTGHTSFGQTSGFTSTAGAQGGFGPTTGAQSALISRIANALANTSTLRSVLRTGVSQQIASSVVQRTIQTLASNLGIDGNNLSRIALQAISQVPAGSDTSAYAQAFSTALVTGGVLNANNVDTLGSQVLSAVLNGVSSAAQGLGINVDTGSVQSDIRSSSSSLSTSSSSASFSQTSGAASTTGFTGAGGYPGGAGPL

SEQ ID NO: 1291 - protein, 203 aa, Araneus ventricosus
GGGVGSLTGQTSFGQTSGFTSTAGAQGGFGPITGAQSALISRIANALANTSTLRSVLRTGVSQQTASSVVQRTIQTLASNLGIDGNNLSRIALQAISQVPAGSDTSAYAQAFSTALVTGGVLNANNVDTLGSQVLSAVLNGVSSAAQGLGINVDTGSVQSDIRSSSSSLSTSSSSASFSQTSGAASTTGFTGAGGYPGGAGPL

SEQ ID NO: 1292 - protein, 203 aa, Araneus ventricosus; identical to SEQ ID NO: 1285

SEQ ID NO: 1293 - protein, 200 aa, Argiope trifasciata
GAGYTGPSGPSTGPSGYPGPLGGGAPFGQSGFGGSDGPQGGFGATGGASAGLISRVANALANTSTLRTVLRTGVSQQIASSVVQRAAQSLASTLGVDGNNLARFAVQAVSRLPAGSDTSAYAQAFSSALFNAGVLNASNIDTLGSRVLSALLNGVSSAAQGLGINVDSGSVQSDISSSSSFLSTSSSSASYSQASASSTS

SEQ ID NO: 1294 - protein, 200 aa, Argiope trifasciata
GAGYTGPSGPSTGPSGYPGLLGGGAPFGQSGFGGSDGPQGGFGATGGASAGLISRVANALANTSTLRTVLRTGVSQQIASSVVQRAAQSLASTLGVDGNNLARFAVQAVSRLPAGSDTSAYAQAFSSALFNAGVLNASNIDTLGSRVLSALLNGVSSAAQGLGINVDSGSVQSDISSSSSFLSTSSSSASYSQASASSTS

SEQ ID NO: 1295 - protein, 200 aa, Argiope trifasciata; identical to SEQ ID NO: 1293

SEQ ID NO: 1296 - protein, 200 aa, Argiope trifasciata
GAGYTGPSGPSTGPSGYPGPLGGGAPFGQSGFGGSAGPQGGFGATGGASAGLISRVANALANTSTLRTVLRTGVSQQIASSVVQRAAQSLASTLGVDGNNLARFAVQAVSRLPAGSDTSAYAQAFSSALFNAGVLNASNIDTLGSRVLSALLNGVSSAAQGLGINVDSGSVQSDISSSSSFLSTSSSSASYSQASASSTS

SEQ ID NO: 1297 - protein, 200 aa, Argiope trifasciata; identical to SEQ ID NO: 1296

SEQ ID NO: 1298 - protein, 200 aa, Argiope trifasciata
GTGYTGPSGPSTGPSGYPGPLGGGAPFGQSGFGGSAGPQGGFGATGGASAGLISRVANALANTSTLRTVLRTGVSQQIASSVVQRAAQSLASTLGVDGNNLARFAVQAVSRLPAGSDTSAYAQAFSSALFNAGVLNASNIDTLGSRVLSALLNGVSSAAQGLGINVDSGSVQSDISSSSSFLSTSSSSASYSQASASSTS

SEQ ID NO: 1299 - protein, 200 aa, Argiope trifasciata; identical to SEQ ID NO: 1296

SEQ ID NO: 1300 - protein, 200 aa, Argiope trifasciata; identical to SEQ ID NO: 1293

SEQ ID NO: 1301 - protein, 189 aa, Parawixia bistriata
GFTGASYPGPQVSQPAPFGVGPQPGGALPGFGQVSGAQSALISRIANALGNTATMRAVLRSGVSQQIVSNVVQGAVQALSSSLGIDGNNLARIASQTILRVPAGSDTSAYAQAFSTALFNSGVLNASNVNTLGSQVVSTLLRGISSTAQGLGLNVDAGSVQSDISSSSSFLSTSSSSTSSSQTTAASTS

SEQ ID NO: 1302 - protein, 189 aa, Parawixia bistriata
GFTGASYPGPQVSQPAPFGVGPQPGGALPGFGQVSGAQSALISRIANALGNTATMRAVLRSGVSQQIVSNVVQGAVQALSSSLGIDGNNLARIASQTILRVPAGSDTSAYAQAFSTALFNSGVLNASNVNTLGSQVVSTLLRGISNTAQGLGLNVDAGSVQSDISSSSSFLSTSSSSTSSSQTTAASTS

SEQ ID NO: 1303 - protein, 177 aa, Uloborus diversus
GASAADIATAIAASVATSLQSNGVLTASNVSQLSNQLASYVSSGLSSTASSLGIQLGASLGAGFGASAGLSASTDISSSVEATSASTLSSSASSTSVVSSINAQLVPALAQTAVLNAAFSNINTQNAIRIAELLTQQVGRQYGLSGSDVATASSQIRSALYSVQQGSASSAYVSAIV

SEQ ID NO: 1304 - protein, 180 aa, Uloborus diversus
GPLITALSSRGVVNASNSSQIASSLATAILQFTANVAPQFGISIPTSAVQSDLSTISQSLTAISSQTSSSVDSSTSAFGGISGPSGPSPYGPQPSGPTFGPGPSLSGLTGFTATFASSFKSTLASSTQFQLIAQSNLDVQTRSSLISKVLINALSSLGISASVASSIAASSSQSLLSVSA

SEQ ID NO: 1305 - protein, 177 aa, Uloborus diversus; identical to SEQ ID NO: 1303

SEQ ID NO: 1306 - protein, 180 aa, Uloborus diversus; identical to SEQ ID NO: 1304

SEQ ID NO: 1307 - protein, 171 aa, Agelenopsis aperta
GPGYGYAAYYAANYGYGPGVGAGSGAGAGSGSGVGAGSGFGAGAGSGTGLGRGAGTGAGAGSGAGSGAGAGSGSGAGAGSGSGAGAGRGAGLGGFGSGLGAGAGTGAGAGSGSGAGSGAGAGAGSGFGAGAGRGAGSGGTGSWLRSGVGTGSSASAGSAGSGAGVGSGAGP

SEQ ID NO: 1308 - protein, 169 aa, Agelenopsis aperta
GPAYGYAAYYAANYGYGPGVGAGSGAGAGSGSGAGAGSGSGAGAGSGAGLGRGAGTGAGAGSGAGSGAGAGSGSGAGAGSGSGAGAGRGAGLGGLGSGLGAGAGTGAGSGSGSGAGSGAGAGAGSGSGAGAGRGAGSGLGAGLGSGVGTGSGAGAGAGSGAGVGSGAGA

SEQ ID NO: 1309 - protein, 164 aa, Agelenopsis aperta
GPGYGYAAYYAANYGYGPGVGAGSGAGAGSGSGAGAGSGSGAGAGSGAGLGRGAGTGAGAGSGAGSGAGAGSGSGAGAGSGSGAGAGRGAGLGGLGAGLGAGAGSGAGAGSGAGAGAGSGSGAGAGRGAGLGGLGAGLGSGVGTGAGAGAGAGSGAGAGSGAGA

SEQ ID NO: 1310 - protein, 168 aa, Agelenopsis aperta
GPGYGYAAYYAANYGYGPGVGAGSGAGAGSGSGSGAGAGSGSGAAAGSGAGLGRGAGTGAGAGSGAGSGAGSGAGAGSGSGAGAGRGAGLGRLGSGLGAGSGTGAGAGSGSGAGSGAGAGAGSGSGAGAGLGAGLGGLGAGLVSGVGTGAGAGAGAGSGAGAGSGAGA

SEQ ID NO: 1311 - protein, 168 aa, Aphonopelma seemanni
GKAISSGAASAAASASAASAAATAVAAASFSASTTTTATSTSAAATGAAAAAGGEAAAVSSTASSSFLQALVSSILERPEFLVPLSHATSASSAYAITSTIVRDAAYETEFSKWATQMSSAAAKEVAEVGSGASAYDYAYAMARGLTKCLSRYNLINSQDPTPSARKL

SEQ ID NO: 1312 - protein, 190 aa, Araneus ventricosus
GGQGGQGGYGGLGSQGAGQGGYGAGQGAAAAAAAAGGAGGAGRGGLGAGGAGQGYGAGLGGQGGAGQAAAAAAAGGAGGARQGGLGAGGAGQGYGAGLGGQGGAGQGGAAAAAAAAGGQGGQGGYGGLGSQGAGQGGYGAGQGGAAAAAAAAGGQGGQGGYGGLGSQGAGQGGYGGRQGGAGAAAAAAAA

SEQ ID NO: 1313 - protein, 218 aa, Argiope aurantia
GGYGPGAGQQGPGGAGQQGPGSQGPGGAGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGLGPYGPSAAAAAAAAGGYGPGAGQQGPGSQGPGSGGQQRPGGLGPYGPSAAAAAAAAGGYGPGAGQQGPGSQGPGSGGQQRPGGLGPYGPSAAAAAAAA

SEQ ID NO: 1314 - protein, 278 aa, Argiope bruennichi
GSAPQGAGGPAPQGPSQQGPVSQGPYGPGAAAAAAAAGGYGPGAGQQGPGSQGPGSGGQQGPGSQGPGSGGQQGPGGQGPYGPSAAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAA

SEQ ID NO: 1315 - protein, 251 aa, Argiope bruennichi
GGYGPGAGQQGPGGAGQQGPGSQGPGGQGPYGPGAGQQGPGSQGPGSGGQQGPGGQGPYGPSAAAAAAAAGGYGPGAGQQGPGSQGPGSGGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAA

SEQ ID NO: 1316 - protein, 228 aa, Argiope bruennichi
GGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQRSQGPGGQGPYGPGAGQQGPGSQGPGSGGQQGPGGQGPYGPSAAAAAAAAGPGAGRQGPGSQGPGSGGQQGPGGQGPYGPSAAAAAAAA

SEQ ID NO: 1317 - protein, 257 aa, Argiope bruennichi
GPGARRQGPGSQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAA

SEQ ID NO: 1318 - protein, 255 aa, Argiope bruennichi
GGYGPGAGQQGPGSGGQQGPGGQGPYGSGQQGPGGAGQQGPGGQGPYGPGAAAAAAAAAGGYGPGAGQQGPGGAGQQGPEGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAA

SEQ ID NO: 1319 - protein, 252 aa, Argiope bruennichi
GGYGPGAGQQGPGGAGQQGPGSQGPGGQGPYGPGAGQQGPGSQGPGSGGQQGPGGQGPYGPSAAAAAAAAGGYGPGAGQQGPGSQGPGSGGQQGPGSQGPGSGGQQGPGGQGPYGPSAAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAA

SEQ ID NO: 1320 - protein, 261 aa, Argiope bruennichi
GGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGGGYGPGAGQQGPGSQGPGSGGQQGPGGQGPYGPSAAAAAAAA

SEQ ID NO: 1321 - protein, 258 aa, Argiope bruennichi
GPGARRQGPGSQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAA

SEQ ID NO: 1322 - protein, 244 aa, Argiope bruennichi
GGQGGRGGFGGLGSQGEGGAGQGGAGAAAAAAAAGADGGFGLGGYGAGRGYGAGLGGAGGAGAASAAAAAGGQGGRSGFGGLGSQGAGGAGQGGAGAAAAAAAAGADGGSGLGGYGAGRGYGASLGGADGAGAASAAAAAGGQGGRGGFGGLGSQGAGGAGQGGAGAAAAAAAASGDGGSGLGGYGAGRGYGAGLGGAGGAGAASAAAAAGGEGGRGGFGGLGSQGAGGAGQGGSLAAAAAAAA

SEQ ID NO: 1323 - protein, 241 aa, Argiope bruennichi
GADGGSGLGGYGAGRGYGAGLGGADGAGAASAAAAAGGQGGRGGFGRLGSQGAGGAGQGGAGAAAAVAAAGGDGGSGLGGYGAGRGYGAGLGGAGGAGAASAAAAAGGQGGRGGFGGLGSQGAGGAGQGGAGAAASGDGGSGLGGYGAGRGYGAGLGGADGAGAASAASAAGGQGGRGGFGGLGSQGAGGAGQGGAGAAAAAATAGGDGGSGLGGYGAGRGYGAGLGGAGGAGAASAAAAA

SEQ ID NO: 1324 - protein, 280 aa, Argiope bruennichi
GGQGGRGGFGGLGSQGAGGAGQGGAGAAAAAAAAGGDGGSGLGGYGAGRGHGVGLGGAGGAGAASAAAAAGGQGGRGGFGGLGSQGAGGAGQGGAGAAAAAAAAGGDGGSGLGGYGAGRGHGAGLGGAGGAGAASAAAAAGGQGGRGGFGGLGSQGSGGAGQGGSGAAAAAAAAGGDGGSGLGGYGAGRGYGAGLGGAGGAGAASAAAAAGGQGGRGGFGGLGSQGAGGAGQGGSGAAAAAAAAVADGGSGLGGYGAGRGYGAGLGGAGGAGAASAAAAT

SEQ ID NO: 1325 - protein, 231 aa, Argiope trifasciata
GGQGGQGGYDGLGSQGAGQGGYGQGGAAAAAAAASGAGSAQRGGLGAGGAGQGYGAGSGGQGGAGQGGAAAATAAAAGGQGGQGGYGGLGSQGSGQGGYGQGGAAAAAAAASGDGGAGQEGLGAGGAGQGYGAGLGGQGGAGQGGAAAAAAAAAGGQGGQGGYGGLGSQGAGQGGYGQGGAAAAAAAASGAGGAGQGGLGAAGAGQGYGAGSGGQGGAGQGGAAAAAAAAA

SEQ ID NO: 1326 - protein, 231 aa, Argiope trifasciata
GGQGGQGGYGGLGSQGAGQGGYGQGGVAAAAAAASGAGGAGRGGLGAGGAGQEYGAVSGGQGGAGQGGEAAAAAAAAGGQGGQGGYGGLGSQGAGQGGYGQGGAAAAAAAASGAGGARRGGLGAGGAGQGYGAGLGGQGGAGQGSASAAAAAAAGGQGGQGGYGGLGSQGSGQGGYGQGGAAAAAAAASGAGGAGRGSLGAGGAGQGYGAGLGGQGGAGQGGAAAAASAAA

SEQ ID NO: 1327 - protein, 135 aa, Argiope trifasciata
GGYGPGAGQQGQQAGQGSGQQGPGGAGQGGPRGQGPYGPGAATAAAAAAGPGYGPGAGQQGPGSQGPGSGGQQGPGSQGPYGPSAAAAAAAAGPGYGPGAGQQGPGSQGPRSGGQQGPGGQGPYGPSAAAAAAAA

SEQ ID NO: 1328 - protein, 140 aa, Argiope trifasciata
GPGYGPGAGQQGPGSGGQQGGPGSGQQGPGGAGQGGPRGQGPYGPGAAAAAAAAAGGYGPGAGQQGPGSQGPGSGGQQGPGSQGPYGPSAAAAAAAAGPGYGPGAGQQGPGSQGPGSGGQQGPGGQGPYGPSAAAAAAAA

SEQ ID NO: 1329 - protein, 140 aa, Artificial Sequence
  Description of Artificial Sequence: Synthetic polypeptide
GPGYGPGAGQQGPGSGGQQGGQGSGQQGPGGAGQGGPRGQGPYGPGAAAAAAAAAGGYGPGAGQQGPGSQGPGSGGQQGPGSQGPYGPSAAAAAAAAGPGYGPGAGQQGPGSQGPGSGGQQGPGGQGPYGPSAAAAAAAA

SEQ ID NO: 1330 - protein, 139 aa, Argiope trifasciata
GPGYGPGAGQQGPGSGGQQGGQGSGQQGPGGAGQGGPRGQGPYGPGAAAAAAAAGGYGPGAGQQGPGSQGPGSGGQQGPGSQGPYGPSAAAAAAAAGPGYGPGAGQQGPGSQGPGSGGQQGPGGQGPYGPSDAAAAAAA

SEQ ID NO: 1331 - protein, 139 aa, Argiope trifasciata
GPGYGPGAGQQGPGSGGQQGGQGSGQQGPGGAGQGGPRGQGPYGPGAAAAAAAAGGYGPGAGQQGPGSQGPGSGGQQGPGSQGPYGPSAAAAAAAAGPGYGPGAGQQGPGSQGPGSGGQQGPGSQGPYGPSAAAAAAAA

SEQ ID NO: 1332 - protein, 184 aa, Avicularia juruensis
GAAAASEAAASAAATSTTTTTSTSRAAAAASAAAAASASGAAGAAGAASAASAASASSSLQQSLGSALAQSSSFAAAFAQASSAASAAAIAYALAQTVANQIGFSSYSSAFARAASSAVYSIGGLASASAYAFAFASAFSQVLSNYGLLNINNAYSLASSIASAASSSASSAAAAAASSSSAAA

SEQ ID NO: 1333 - protein, 183 aa, Artificial Sequence
  Description of Artificial Sequence: Synthetic polypeptide
GAAAASGTAASAAATSTTTTTSTSRAAAAASAAAAASASGAADAAGAASAASAASASSSLQQSLGSALAQSSSFAAAFAQANSAASAAAIAYALAQTVANQIGFSSYSSAFASAASSAVSSLGGFASASAYAFAFASAFSQVLSNYGLLNINNAYSLASSIASAASSSASSAAAAASSSSAAA

SEQ ID NO: 1334 - protein, 177 aa, Avicularia juruensis
GSGAARAAQTASAASAASASSSLQQSLGSALAQSSSFAAAFDQANSAASAAAIAYALAQSAANQVGLSSYSAAISNAAAAAVGSVGGYASASAYAFAFASGVSQVLSNYGLINLSNALFLASSIANAASASASSAAAAASSSSAATGAAAALGGAGSAAATSTTTITSTSTAVAAAS

SEQ ID NO: 1335 - protein, 236 aa, Artificial Sequence
  Description of Artificial Sequence: Synthetic polypeptide
GPGGYGGPGQQGPGQGQQQGPASAAAAAAAAGPGGYGGPGQQGPGQGQQQGPASAAAAAAAAAGPGGYGGPGQQRPGQAQYGRGTGQQGQGPGAQQGPASAAAAAAAGAGLYGGPGQQGPGQGQQQGPASAAAAAAAAAAAGPGGYGGPGQQGPGQAQQQGPASAAAAAAAGPGGYSGPGQQGPGQAQQQGPASAAAAAAAAAGPGGYGGPGQQGPGQGQQQGPASAAAAAAATAA

SEQ ID NO: 1336 - protein, 228 aa, Deinopis spinosa
GPGGYGGPGQQGPGQGQYGPGTGQQGQGPSGQQGPAGAAAAAAAAAGPGGYGGPGQQGPGQGQYGPGAGQQGQGPGGQQGPAGAAAAAAAAAGPGGYGGPGQQGPGQGQQQGRAGAAAAAAAGPGGYGGPGQQGPGQAQQQGPAAAASAGPGGYGGPGQQGPGQGQQKGPASAAAAAAATAAGPGGYGGPGQQGPGQGQYGPGTGQQGQGPGGQQGPASAAAAAAAAA

SEQ ID NO: 1337 - protein, 244 aa, Deinopis spinosa
GPGGYGGPGQPGPGQGQYGPGPGQQGPRQGGQQGPASAAAAAAAGPGGYGGPGQQGPRQGQQQGPASAAAAAAAAAAGPRGYGGPGQQGPVQGGQQGPASAAAAAAAAGVGGYGGPGQQGPGQGQYGPGTGQQGQGPSGQQGPAGAAAAAAGGAAGPGGYGGPGQQGPGQGQYGPGTGQQGQGPSGQQGPAGAAAAAAAAAGPGGYGGPGQQGPGQGQYGPGAGQQGQGPGSQQGPASAAAAAA

SEQ ID NO: 1338 - protein, 300 aa, Deinopis spinosa
GPGGYGGPGQQGPGQGQYGPGTGQQGQGPGGQQGPVGAAAAAAAAVSSGGYGSQGAGQGGQQGSGQGGPAAAGPGGYGGPGQQGPEQGQYGSGAGQQGQGPGGQQGPASAAAAAAAGPGRYGGPGQQGPGQGQYGPGTGQQGQGPASAAAAAAAGPGGYGGPGQQGPGQGRGTGQQGQGLGGQQGPDSAAAAAAAAGPGGYGGPGQQGPGQGQYGPGTGQQGQGPGGQQGPVGAAAAAAAAVSSGGYGSQGAGQGGQQGSGQRGPAAAGPGGYSGPGQQGPGQGGQQGPASAAAAAAAAA

SEQ ID NO: 1339 - protein, 242 aa, Deinopis spinosa
GPGGYVGSGQQGPGQGRGTGQQGQGTGGQQGPASAAASAAAGPGGYGGPGQQGPGQGGQQGPATAAAAAAAAAGPGGYGGPGQQGPGQGQYGPGTGQQGQGPGGQQGPAGAAATAAAAAGPGGYGGPGQQGPEQGQYRPGAGQQGQGPGGQQGPASAAAAAAAGPGGYGGPGQQGPGRGQYGPGTGQQGQGPASAAAAAAAGPGGYGGPGQQGPGQGRGTGQQGQGLGGQQGPDSAAAAAAA

SEQ ID NO: 1340 - protein, 229 aa, Deinopis spinosa
GPGGYGGPGQQGPGQGQYGPGTGQQGQGPGGQQGPVGAAAAAAAAVSSGGYGSQGAGQGGQQGSGQRGPAAAGPGGYSGPGQQGPGQGGQQGPASAAAAAAAAAGPGGYGGSGQQGPGQGRGTGQQGQGPGGQQGPASAAAAAAAGPGGYGGPGQQGPGQGQYGPGTGQQGQGPASAAAAAAAGPGGYGGPGQQGPGQGQYGPGTGQQGQGPGGQQGPGGASAAAAAAA

SEQ ID NO: 1341 - protein, 156 aa, Diguetia canities
GTGGVGGLFLSSGDFGRGGAGAGAGAAAASAAAASSAAAGARGGSGFGVGTGGFGRGGAGAGTGAAAASAAAASAAAAGAGGDGGLFLSSGDFGRGGAGAGAGAAAASAAAASSAAAGARGGSGFGVGTGGFGRGGAGDGASAAAASAAAASAAAA

SEQ ID NO: 1342 - protein, 234 aa, Diguetia canities
GAGGDGGLFLSSGDFGRGGAGAGAGAAAASAAAASSAAAGARGGSGFGVGTGGFGRGGAGDGASAAAASAAAASAAAAGAGGDSGLFLSSGDFGRGGAGAGAGAAAASAAAASAAAAGTGGVGGLFLSSGDFGRGGAGAGAGAAAASAAAASSAAAGARGGSGFGVGTGGFGRGGPGAGTGAAAASAAAASAAAAGAGGDSGLFLSSEDFGRGGAGAGTGAAAASAAAASAAAA

SEQ ID NO: 1343 - protein, 243 aa, Diguetia canities
GSGAGQGTGAGAGAAAAAAGAAGSGAGQGAGSGAGAAAAAAAASAAGAGQGAGSGSGAGAAAAAAAAAGAGQGAGSGSGAGAAAAAAAAAAAAQQQQQQQAAAAAAAAAAAAAGSGQGASFGVTQQFGAPSGAASSAAAAAAAAAAAAAGSGAGQEAGTGAGAAAAAAAAGAAGSGAGQGAGSGAGAAAAAAAAASAAGAGQGAGSGSGAGAAAAAAAAAAAAQQQQQQQAAAAAAAAAAAAA

SEQ ID NO: 1344 - protein, 189 aa, Dolomedes tenebrosus
GGAGQSGSGPYGASYLSSTTYTTSSQGAGGGVGGYGQGSGTGSAAAAAGAAGAGQGGQGGYGQGAGQGGLGGYGQGGGAGAAAAAAAAAGGAGSGQGGYGGQGGLGGYGQGAGAGAAAAAAAGGAGAGQGGFGGQGGYGQGGGAGAAAAAAAAAAAGGAGSGQGGYGGQGGLGGYGQGAGAGAAAAAAA

SEQ ID NO: 1345 - protein, 166 aa, Dolomedes tenebrosus
GGAGAGQGSYGGQGGYGQGGAGAATATAAAAGGAGSGQGGYGGQGGLGGYGQGAGAGAAAAAAAAAGGAGAGQGGYGGQGGQGGYGQGAGAGAAAAAAGGAGAGQGGYGGQGGYGQGGGAGAAAAAAAASGGSGSGQGGYGGQGGLGGYGQGAGAGAGAAASAAAA

SEQ ID NO: 1346 - protein, 152 aa, Dolomedes tenebrosus
GAGSGQGGYGGQGGLGGYGQGAGAGAAAGASGSGSGGAGQGGLGGYGQGAGAGAAAAAAGASGAGQGGFGPYGSSYQSSTSYSVTSQGAAGGLGGYGQGSGAGAAAAGAAGQGGQGGYGQGAGAGAGAGAGQGGLGGYGQGAGSSAASAAAA

SEQ ID NO: 1347 - protein, 228 aa, Euprosthenops australis
GQGGQGGYGGLGQGGYGQGAGSSAAAAAAAAAAAAAAGRGQGGYGQGSGGNAAAAAAAAAAAASGQGGQGGQGGQGQGGYGQGAGSSAAAAAAAAAAAAAAGQGQGRYGQGAGGNAAAAAAAAAAAAAGQGGQGGQGGLGQGGYGQGAGSSAAAAAASAAAAAAGRGQGGYGQGAGGNAAAAAAAAAAAAAAGQGGQGGYGGLGQGGYGQGAGSSAAAAAAAAAAAAA

SEQ ID NO: 1348 - protein, 187 aa, Euprosthenops australis
GGQGGQGQGRYGQGAGSSAAAAAAAAAAAAAAGQGQGGYGQGAGGNAAAAAAAAAAAAAGQGGQGGQGGLGQGGYGQGAGSSAAAAAAAAAAAAAGRGQGGYGQGAGGNAAAAAAAAAEAAAAGQGGQGGYGGLGQGGYGQGAGSSAAAAAAAAAAAAAGRGQGGYGQGAGGNAAAAAAAAAAAAAA

SEQ ID NO: 1349 - protein, 195 aa, Euprosthenops australis
GQGGQGGYGGLGQGGYGQGAGSSAAAAAAAAAAAAAGGQGGQGQGRYGQGAGSSAAAAAAAAAAAAAAGRGQGGYGQGSGGNAAAAAAAAAAAASGQGSQGGQGGQGQGGYGQGAGSSAAAAAAAAAAAAASGRGQGGYGQGAGGNAAAAAAAAAAAAAAGQGGQGGYGGLGQGGYGQGAGSSAAAAAAAAAAAA

SEQ ID NO: 1350 - protein, 187 aa, Euprosthenops australis
GGQGGQGQGGYGQGAGSSAAAAAAAAAAAAAAGRGQGGYGQGSGGNAAAAAAAAAAAASGQGGQGGQGGQGQGGYGQGAGSSAAAAAAAAAAAAAAGQGQGGYGQGAGGNAAAAAAAAAAAAAGQGGQGGQGGLGQGGYGQGAGSSAAAAAAAAAAAAAAGRGQGGYGQGVGGNAAAAAAAAAAAAA

SEQ ID NO: 1351 - protein, 225 aa, Euprosthenops australis
GQGGQGGQGGLGQGGYGQGAGSSAAAAAAAAAAAAAAGRGQGGYGQGSGGNAAAAAAAAAAAASGQGSQGGQGGQGQGGYGQGAGSSAAAAAAAAAAAAASGRGQGGYGQGAGGNAAAAAAAAAAAAAAGQGGQGGYGGLGQGGYGQGAGSSAAAAAAAAAAAAGGQGGQGQGGYGQGSGGSAAAAAAAAAAAAAAAGRGQGGYGQGSGGNAAAAAAAAAAAAAA

SEQ ID NO: 1352 - protein, 219 aa, Euprosthenops australis
GGQGGFSGQGQGGFGPGAGSSAAAAAAAAAAARQGGQGQGGFGQGAGGNAAAAAAAAAAAAAAQQGGQGGFSGRGQGGFGPGAGSSAAAAAAGQGGQGQGGFGQGAGGNAAAAAAAAAAAAAAAGQGGQGRGGFGQGAGGNAAAAAAAAAAAAAAAQQGGQGGFGGRGQGGFGPGAGSSAAAAAAGQGGQGRGGFGQGAGGNAAAASAAAAASAAAAGQ

SEQ ID NO: 1353 - protein, 192 aa, Euprosthenops australis
GGQGRGGFGQGAGGNAAAAAAAAAAAAAAQQVGQFGFGGRGQGGFGPFAGSSAAAAAAASAAAGQGGQGQGGFGQGAGGNAAAAAAAAAAAARQGGQGQGGFSQGAGGNAAAAAAAAAAAAAAAQQGGQGGFGGRGQGGFGPGAGSSAAAAAAATAAAGQGGQGRGGFGQGAGSNAAAAAAAAAAAAAAAGQ

SEQ ID NO: 1354 - protein, 163 aa, Euprosthenops australis
GQGGQGGYGGLGQGGYGQGAGSSAAAAAAAAAAAGRGQGGYGQGSGGNAAAAAAAAAAAASGQGGQGGQGGQGQGGYGQGAGSSAAAAAAAAAAAAAAAGRGQGGYGQGAGGNAAAAAAAAAAAASGQGGQGGQGGQGQGGYGQGAGSSAAAAAAAAAAAAAA

SEQ ID NO: 1355 - protein, 179 aa, Euprosthenops australis
GRGQGGYGQGSGGNAAAAAAAGQGGFGGQEGNGQGAGSAAAAAAAAAAAAGGSGQGRYGGRGQGGYGQGAGAAASAAAAAAAAAAGQGGFGGQEGNGQGAGSAAAAAAAAAAAAGGSGQGGYGGRGQGGYGQGAGAAAAAAAAAAAAAAGQGGQGGFGSQGGNGQGAGSAAAAAAAAAA

SEQ ID NO: 1356 - protein, 214 aa, Gasteracantha mammosa
GGYRPVSGQQGPGQQGPGSGGQQGPGGQRPYGPGAAAAAAAAGGYGPGSGQGGPGQQGPGSGGQQGPGGQGPYGPGAAAAAAAAAGGYGPGSGQGGQQGPGSQGPGSGGQQGPGGQGPYGPSAAAAAAAVGGYGPGAGQQGPGQQGPGSGGQRGPGGQGPYGPGAAAAAAAAAGGYGPASGQQGPGQQGPGSGGQRGPGGQGPYGPGAAAAASA

SEQ ID NO: 1357 - protein, 180 aa, Hypochilus thorelli
GASGAGQGQGYGQQGQGGSSAAAAAAAAAAAAAAAQGQGQGYGQQGQGSAAAAAAAAAAGASGAGQGQGYGQQGQGSAAAAAAAAAAGASGAGQGQGYGQQGQGGSSAAAAAAAAAAAAAAAAQGQGYGQQGQGSAAAAAAAAAGASGAGQGQGYGQQGQGGSSAAAAAAAAAAAAAAAA

SEQ ID NO: 1358 - protein, 150 aa, Hypochilus thorelli
GASGAGQGQGYGQQGQGGSSAAAAAAAAAAAQGQGQGYGQQGQGYGQQGQGGSSAAAAAAAAAAAAAQGQGQGYGQQGQGSAAAAAAAAAGASGAGQGQGYGQQGQGGSSAAAAAAAAAAAAAAAQGQGYGQQGQGSAAAAAAAAAAAAA

SEQ ID NO: 1359 - protein, 182 aa, Kukulcania hibernalis
GEAFSASSASSAVVFESAGPGEEAGSSGDGASAAASAAAAAGAGSGRRGPGGARSRGGAGAGAGAGSGVGGYGSGSGAGAGAGAGAGAGGEGGFGEGQGYGAGAGAGFGSGAGAGAGAGSGAGAGEGVGSGAGAGAGAGFGVGAGAGAGAGAGFGSGAGAGSGAGAGYGAGRAGGRGRGGRG

SEQ ID NO: 1360 - protein, 182 aa, Kukulcania hibernalis
GEAFSASSASSAVVFESAGPGEEAGSSGGGASAAASAAAAAGAGSGRRGPGGARSRGGAGAGAGAGSGVGGYGSGSGAGAGAGAGAGAGGEGGFGEGQGYGAGAGAGFGSGAGAGAGAGSGAGAGEGVGSGAGAGAGAGFGVGAGAGAGAGAGFGSGAGAGSGAGAGYGAGRAGGRGRGGRG

SEQ ID NO: 1361 - protein, 183 aa, Megahexura fulva
GSYAYAQAAAGAFANVLFQAGVLTYANASALASAYASAYASSVASAAASASAGASASSGASASASAAAAAAAAAAASASAGASASAGASASAGASASASASATASAFASAFASAVVQTGYFSNVFGNVYSAAQASYYASASAQAAASAAGFGSSVANAVASASASAAGGVSVGAGAQAYASAL

SEQ ID NO: 1362 - protein, 182 aa, Megahexura fulva
GNGLGQALLANGVLNSGNYLQLANSLAYSFGSSLSQYSSSAAGASAAGAASGAAGAGAGAASSGGSSGSASSSTTTTTTTSTSAAAAAAAAAAAASAAASTSASASASASASASAFSQTFVQTVLQSAAFGSYFGGNLSLQSAQAAASAAAQAAAQQIGLGSYGYALANAVASAFASAGANA

SEQ ID NO: 1363 - protein, 183 aa, Megahexura fulva; identical to SEQ ID NO: 1361

SEQ ID NO: 1364 - protein, 182 aa, Megahexura fulva; identical to SEQ ID NO: 1362

SEQ ID NO: 1365 - protein, 183 aa, Megahexura fulva; identical to SEQ ID NO: 1361

SEQ ID NO: 1366 - protein, 182 aa, Artificial Sequence; identical to SEQ ID NO: 1362
  Description of Artificial Sequence: Synthetic polypeptide

SEQ ID NO: 1367 - protein, 213 aa, Nephila clavipes
GGAGQGGYGGLGGQGAGQGGYGGLGGQGAGQGAGAAAAAAAGGAGQGGYGGLGSQGAGRGGQGAGAAAAAAGGAGQGGYGGLGSQGAGRGGLGGQGAGAAAAAAAGGAGQGGYGGLGNQGAGRGGQGAAAAAAGGAGQGGYGGLGSQGAGRGGLGGQGAGAAAAAAGGAGQGGYGGLGGQGAGQGGYGGLGSQGAGRGGLGGQGAGAAAAAAA

SEQ ID NO: 1368 - protein, 186 aa, Nephila clavipes
GGAGQGGLGGQGAGQGAGASAAAAGGAGQGGYGGLGSQGAGRGGEGAGAAAAAAGGAGQGGYGGLGGQGAGQGGYGGLGSQGAGRGGLGGQGAGAAAAGGAGQGGLGGQGAGQGAGAAAAAAGGAGQGGYGGLGSQGAGRGGLGGQGAGAVAAAAAGGAGQGGYGGLGSQGAGRGGQGAGAAAAAA

SEQ ID NO: 1369 - protein, 188 aa, Nephila clavipes
GGAGQRGYGGLGNQGAGRGGLGGQGAGAAAAAAAGGAGQGGYGGLGNQGAGRGGQGAAAAAGGAGQGGYGGLGSQGAGRGGQGAGAAAAAAVGAGQEGIRGQGAGQGGYGGLGSQGSGRGGLGGQGAGAAAAAAGGAGQGGLGGQGAGQGAGAAAAAAGGVRQGGYGGLGSQGAGRGGQGAGAAAAAA

SEQ ID NO: 1370 - protein, 216 aa, Nephila clavipes
GPGGYGPGQQGPGGYGPGQQGPGRYGPGQQGPSGPGSAAAAAAGSGQQGPGGYGPRQQGPGGYGQGQQGPSGPGSAAAASAAASAESGQQGPGGYGPGQQGPGGYGPGQQGPGGYGPGQQGPSGPGSAAAAAAAASGPGQQGPGGYGPGQQGPGGYGPGQQGPSGPGSAAAAAAAASGPGQQGPGGYGPGQQGPGGYGPGQQGLSGPGSAAAAAAA

SEQ ID NO: 1371 - protein, 212 aa, Nephila clavipes
GPGQQGPGGYGPGQQGPSGPGSAAAAAAAAAGPGGYGPGQQGPGGYGPGQQGPSGAGSAAAAAAAGPGQQGLGGYGPGQQGPGGYGPGQQGPGGYGPGSASAAAAAAGPGQQGPGGYGPGQQGPSGPGSASAAAAAAAAGPGGYGPGQQGPGGYAPGQQGPSGPGSASAAAAAAAAGPGGYGPGQQGPGGYAPGQQGPSGPGSAAAAAAAAA

SEQ ID NO: 1372 - protein, 208 aa, Nephila madagascariensis
GRGPEGYGPRQQGPGATAAAAGPGGYGPRQQGPGGYGPGQQGPGAAAAAAAGRGPGGYGPGQQGPGGPGAAAAAAGSEGYGPGQQGPRGPGAAAAGPGGYGPGQQGASAAASAAAGRGPGGYGPGQQGPGGPSAAAAGPGGYGPGQQGPSAAAAAAAGSGPGGYGPGQQGPGGPGAAAAAAGPGGYGPGQQGPGAAAAAAGQAAAAAA

SEQ ID NO: 1373 - protein, 225 aa, Nephila madagascariensis
GRGPGGYGPGQQGPGGPGAAAAAAGPGGYGPGGYGPGQQGPGGPGAAAAAAAGRGPGGYGPGQQGPGQQGPGGSGAAAAAAGRGPGGYGPGQQGPGGPGAAAAAAGPGGYGPGQQGPGAAAAAAAAGRGPGGYGPGQQGPGGPGAAAAAAAGRGPGGYGPGQQGPGQQGPGGSGAAAAAAGRGPGGYGPGQQGPGGPGAAAAAAGPGGYGPGQQGPGAAAAAAAA

SEQ ID NO: 1374 - protein, 225 aa, Nephila madagascariensis
GRGPGGYGPGQQGPGGSGAAAAAAGRGPGGYGPGQQGPGGPGAAAAAAGPGGYGPGQQGTGAAAAAAAGSGAGGYGPGQQGPGGPGAAAAAAGPGGYGPGQQGPGAAAAAAAGSGPGGYGPGQQGPGGSSAAAAAAGPGRYGPGQQGPGAAAAASAGRGPGGYGPGQQGPGGPGAAAAAAGPGGYGPGQQGPGAAAAAAAGSGPGGYGPGQQGPGGPGAAAAAAA

SEQ ID NO: 1375 - protein, 216 aa, Nephila madagascariensis
GRGPGGYGQGQQGPGGPGAAAAAAGPGGYGPGQQGPGAAAAAAAGSGPGGYGPGQQGPGRSGAAAAAAAAGRGPGGYGPGQQGPGGPGAAAAAAGPGGYGPGQQGPGAAAAASAGRGPGGYGPGQQGPGGSGAAAAAAGRGPGGYGPGQQGPGGPGAAAAAAAGRGPGGYGPGQQGPGQQGPGGSGAAAAAAGRGPGGYGPGQQGPGGPGAAAAAA

SEQ ID NO: 1376 - protein, 224 aa, Nephila madagascariensis
GPGGYGPGQQRPGQQGPGGPGAAAAAAGRGPGGYGPGQQGPGGPGAAAAAAAGRGPGGYGPGQQGPGQQGPGGSGAAAAAAGRGPGGYGPGQQGPGGPGAAAAAAGPGGYGPGQQGPGAAAAAAAAGRGPGGYGPGQQGPGGPGAAAAAAAGRGPGGYGPGQQGPGQQGPGGPGAAAAAAGPGGYGPGQQGTGAAAAAAAGSGAGGYGPGQQGPGGPGAAAAAA

SEQ ID NO: 1377 - protein, 203 aa, Nephila madagascariensis
GPGGYGPGQQGPGAAAAAAAGSGPGGYGPGQQGPGGSSAAAAAAGPGRYGPGQQGPGAAAAAAAGSGPGGYGPGQQGPGGPGAAAAAAAAGRGPGGYGPGQQGPGGPGAAAAAAGPGGYGPGQQGPGAAAAAAAGSGPGGYGPGQQGPGGPGAAAAAAAGRGPGGYGQGQQGPGGPGAAAAAAGPGGYGPGQQGPGAAAAAAA

SEQ ID NO: 1378 - protein, 187 aa, Nephila madagascariensis
GSGPGGYGPGQQGPGRSGAAAAAAAAGRGPGGYGPGQQGPGGPGAAAAAAGPGGYGPGQQGPGAAAAASAGRGPGGYGPGQQGPGGSGAAAAAAGRGPGGYGPGQQGPGGPGAAAAAAAGTGPGGYGPGQQGPGGSGAAAAAAGRGPGGYGPGQQGPGGPGAAAAAAGPGGYGPGQQGPGAAAAAAA

SEQ ID NO: 1379 - protein, 174 aa, Nephila madagascariensis
GSGPGGYGPGQQGPGGPGAAAAAAGRGPGGYGPGQQGPGGPGAAAAAAAGRGPGGYGPGQQGPGGSGAAAAASGRGPGGSGPGGYGPGQQGPGAAAAAAAAGRGPGGYGPGQQGPGGPGAAAAAAAGRGPGGYGPGQQGPGGSGAAAAAAGRGPGGYGPGQQGPGGPGAAAAAA

SEQ ID NO: 1380 - protein, 156 aa, Nephila madagascariensis
GPGGYGPGQQGPGAAAAAAGRGPGGYGPGQQGPGGSGAAAAAAGRGPGGYGPGQQGPGGPGAAAAAAGPGGYGPGQQGTGAAAAAAAGSGAGGYGPGQQGPGGPGAAAAAAGPGGYGPGQQGPGAAAAAAAGSGPGGYGPGQQGPGGPGAAAAAAA

SEQ ID NO: 1381 - protein, 175 aa, Nephila pilipes
GGAGQGGYSGLDRQRSGAAAAGASVAAQGGYGGLGGQGAGAAGAAAAGGAGRGGYGGLVGQGAGAAAAGAGEAGQGGYGSLGGQGTGAGGEAAAATGGAGQGGYGGLGGQGASAAGSAGQGGYGGLAGQRAGAAATGGLFDGSRDVGGFSFAVSGSSGGYRRGGYVGNSTAAAAA

SEQ ID NO: 1382 - protein, 177 aa, Nephilengys cruentata
GGAGQGGYGGLGGQGAGAAAAAAGGAGQGGYGGQGAGQGAAAAAASGAGQGGYEGPGAGQGAGAAAAAAGGAGQGGYGGLGGQGAGQGAGAAAAAAGGAGQGGYGGLGGQGAGQGAGAAAAAAGGAGQGGYGGQGAGQGAAAAAAGGAGQGGYGGLGSGQGGYGRQGAGAAAAAAAA

SEQ ID NO: 1383 - protein, 174 aa, Nephilengys cruentata
GGAGQGGYGGLGGQGAGAAAAAAGGAGQGGYGGQGAGQGAAAAAASGAGQGGYGGPGAGQGAGAAAAAAGGAGQGGYGGLGGQGAGQGAGAAAAAAGGAGQGGYGGQGAGQGAAAAAAGGAGQGGYGGLGSGQGGYGGQGAGAAAAAGGAGQGGYGGLGGQGAGQGAGAAAAAA

SEQ ID NO: 1384 - protein, 148 aa, Artificial Sequence
  Description of Artificial Sequence: Synthetic polypeptide
GGYGPGSGQQGPGAGQQGPGAGQQGPYGPSAAAAAAAAGGYGPGGAGQQGPGAGQQGPGSQGQSGPGATVAAAAAGGYGPGGAGQQGPGAGQQGQGSQGPYGPAATAAAAAAGGYGPGSGQQGPGAGQQGPGGQGPYGPSAAAAAAAA

SEQ ID NO: 1385 - protein, 146 aa, Parawixia bistriata
GGYGPGSGQQGPGAGPQGPGSQGPYGPGAAAAAAAVGGYGPGSGQQGPGAGQQGPGGQGPYGPSSAAAAAAAGGYGPGGAGQQVPGAGQQGPGNQGPSGPGAAAAAAAAGGYGPGGAGQQGPAAGQQGPGSQGSYGPGAAAAAAAA

SEQ ID NO: 1386 - protein, 193 aa, Parawixia bistriata
GGLGGQGGLGGLGSQGAGLGGYGQGGAGQGGAAAAAAAAGGLGGQGGRGGLGSQGAGQGGYGQGGAGQGGAAAAAAAAGGLGGQGGLGALGSQGAGQGGAGQGGYGQGGAAAAAAGGLGGQGGLGGLGSQGAGQGGYGQGGAGQGGAAAAAAAAGGLGGQGGLGGLGSQGAGPGGYGQGGAGQGGAAAAAAAA

SEQ ID NO: 1387 - protein, 166 aa, Parawixia bistriata
GGLGGQGGLGALGSQGAGQGGYGQGGAGQGGAAAAAAAGGLGGQGGLGALGSQGAGQGGYGQGGSQGAGQGGYGQGGAAAAAAAAGGLGGQGGLGGLGSQGAGQGGYGQGGSQGAGQGGAAAAAAAAGGLGGQGGFGGLGSQGAGQGGYGQGGAGQGGAAAAAAAA

SEQ ID NO: 1388 - protein, 241 aa, Peucetia viridans
GAGAGQGGRGGYGQGGFGGQGSGAGAGASAAAGAGAGQGGRGGYGQGGFGGQGSGAGAGASAAAGAGAGQGGRGGYGQGGFGGQGSGAGAGASAAAAAGAGQGGRGGYGQGGLGGSGSGAGAGAGAAAAAAAGAGGYGQGGLGGYGQGAGAGQGGLGGYGSGAGAGASAAAAAGAGGAGQGGLGGYGQGAGAGQGGLGGYGSGAGAGAAAAAAAGAGGSGQGGLGGYGSGGGAGGASAAAA

SEQ ID NO: 1389 - protein, 166 aa, Poecilotheria regalis
GASDSAAAAALSAASASAASAATAVSTTTSTSTSAATAAAAAASAAGAAGAGAAAGATASSSFGQNLLSGLLRSDAVVSALSQAYSASTASALASSYAQSGADRAGFGNYGSVIASAAASAVASAGNNAGAYAYARAYASAISQSLSSLGILNSGNAIALANAFSS

SEQ ID NO: 1390 - protein, 166 aa, Poecilotheria regalis
GASDSAAAAAVSAASASAASAATASSRTTSTSTSAATAAAAAASAAGSAGAGAAAGATASSSFGQNLLSGLLRSDAVVSALSQAYSASTASALASSYAQSGADRAGLGNYGSVIASAAASAVASAGNNAGAYAYARAYASAISQSLSSLRILNSGNAIALANAFSS

SEQ ID NO: 1391 - protein, 166 aa, Poecilotheria regalis
GASDSAAAAALSAASASAASAATAASTTTSTSTSAATAAAAAASAAGAAGAGAAAGATASSSFGQNLLSGLLRSDAVVSALSQAYSASTASALASSYAQSGADRAGLGNYGSVIASAAASAVASAGNNAGAYAYARAYASAISQSLSSLGILNSGNAIALANAFTS

SEQ ID NO: 1392 - protein, 174 aa, Artificial Sequence
  Description of Artificial Sequence: Synthetic polypeptide
GGLGGGQGAGQGGQQGAGQGGYGSGLGGAGQGAGQGASAAAAAAAGGLGGGQGAGQGGQQGAGQGGYGSGLGGAGQGASAAAAAAAAGGLGGGQGAGQGGQQGAGQGGYGSGLGGAGQGASAAAAAAAAGGLGGGQGAGQGGQQGAGQGGYGSGLGGAGQGAGQGASAAAAAAA

SEQ ID NO: 1393 - protein, 177 aa, Artificial Sequence
  Description of Artificial Sequence: Synthetic polypeptide
GGSGGQGGQGGYGSGGQGQGQGGYGSGAAAAAAAAAGGSGGQGGQGGYGSGGQGQGQGGYGAGAAAAAAAAAGGSGGQGGAGAGGQGGQGQGQGGYGSGAAAAAAAAAGGLGGQGGYGSGRQGQGQGGYGSGAAAAAAAAAGGSGGQGAQGGYGSGGQGQGQGGYGSGAAAAAAAAA

SEQ ID NO: 1394 - protein, 189 aa, Argiope bruennichi
GGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQRSQGPGGQGPYGPGAGQQGPGSQGPGSGGQQGPGGQGPYGPSAAAAAAAA

SEQ ID NO: 1395 - protein, 126 aa, Argiope bruennichi
GGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAA

SEQ ID NO: 1396 - protein, 315 aa, Argiope bruennichi
GGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQRSQGPGGQGPYGPGAGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAA

SEQ ID NO: 1397 - protein, 630 aa, Artificial Sequence
  Description of Artificial Sequence: Synthetic polypeptide
GGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQRSQGPGGQGPYGPGAGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQRSQGPGGQGPYGPGAGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAA

SEQ ID NO: 1398 - protein, 945 aa, Artificial Sequence
  Description of Artificial Sequence: Synthetic polypeptide
GGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQRSQGPGGQGPYGPGAGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQRSQGPGGQGPYGPGAGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQRSQGPGGQGPYGPGAGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAA

SEQ ID NO: 1399 - DNA, 6827 bp, Artificial Sequence
  Description of Artificial Sequence: Synthetic polynucleotide
gcgatcgcggtctcactatccagaaaacggaacagattatggaattagtcaaaccaattgtcgacaatgttcgtcaaaatggtgacaaagcccttttagaactaactgccaagtttgatggagtcgctttgaagacacctgtgttagaagctcctttcccagaggaacttatgcaattgccagataacgttaagagagccattgatctctctatagataacgtcaggaaattccatgaagctcaactaacggagacgttgcaagttgagacttgccctggtgtagtctgctctcgttttgcaagacctattgagaaagttggcctctatattcctggtggaaccgcaattctgccttccacttccctgatgctgggtgttcctgccaaagttgctggttgcaaagaaattgtttttgcatctccacctaagaaggatggtacccttaccccagaagtcatctacgttgcccacaaggttggtgctaagtgtatcgtgctagcaggaggcgcccaggcagtagctgctatggcttacggaacagaaactgttcctaagtgtgacaaaatatttggtccaggaaaccagttcgttactgctgccaagatgatggttcaaaatgacacatcagccctgtgtagtattgacatgcctgctgggccttctgaagttctagttattgctgataaatacgctgatccagatttcgttgcctcagaccttctgtctcaagctgaacatggtattgattcccaggtgattctgttggctgtcgatatgacagacaaggagcttgccagaattgaagatgctgttcacaaccaagctgtgcagttgccaagggttgaaattgtacgcaagtgtattgcacactctacaaccctatcggttgcaacctacgagcaggctttggaaatgtccaatcagtacgctcctgaacacttgatcctgcaaatcgagaatgcttcttcttatgttgatcaagtacaacacgctggatctgtgtttgttggtgcctactctccagagagttgtggagattactcctccggtaccaaccacactttgccaacgtacggatatgcccgtcaatacagcggagttaacactgcaaccttccagaagttcatcacttcacaagacgtaactcctgagggactgaaacatattggccaagcagtgatggatctggctgctgttgaaggtctagatgctcaccgcaatgctgttaaggttcgtatggagaaactgggacttatttaattatttagagattttaacttacatttagattcgatagatctaaccggcatctaacatccagtgtttctaatctagtgaatcgagatcaagtctcactctgaacataataaataaggtctaaccccatggaattacatgtccccttgggttctgagattgtcttacccggtggggaaagagccatactcaagttcgtaggaaatgtggagtcaaagtctgggatttttgctggtgttgaactgattggtcaaatgagtggaaaaggaaacctcagctttttgtagaatgtcttggtgtcctcgtccaatcaggtagccatctctgaaatatctggctccgttgcaactccgaacgacctgctggcaacgtaaaattctccggggtaaaacttaaatgtggagtaatggaaccagaaacgtctcttcccttctctctccttccaccgcccgttaccgtccctaggaaattttactctgctggagagcttcttctacggcccccttgcagcaatgctcttcccagcattacgttgcgggtaaaacggaggtcgtgtacccgacctagcagcccagggatggaaaagtcccggccgtcgctggcaataatagcgggcggacgcatgtcatgagattattggaaaccaccagaatcgaatataaaaggcgaacacctttcccaattttggtttctcctgacccaaagactttaaatttaatttatttgtccctatttcaatcaattgaacaactatcaggcgcgccgaaacgatgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaaggtatcgctcatcgcgaaagtgaaacgtgatttcatgcgtcattttgaacattttgtaaatcttatttaataatgtgtgcggcaattcacatttaatttatgaatgttttcttaacatatcgcggcaactcaagaaacggcaggttcggatcttagctactagagattaaggaggtaaaaaaaatgagtgtgatcgctaaacaaatgacctacaaggtttatatgtcaggcacggtcaatggacactactttgaggtcgaaggtgatggaaaaggtaagccctacgagggggagcagacggtaaagctcactgtcaccaagggcggacctctgccatttgcttgggatattttatcaccacagtgtcagtacggaagcataccattcaccaagtaccctgaagatatccctgactatgtaaagcagtcattcccggagggctatacatgggagaggatcatgaactttgaagatggtgcagtgtgtactgtcagcaatgattccagcatccaaggcaactgtttcatctaccatgtcaagttctctggtttgaactttcctcccaatggacctgtcatgcagaagaaaacacagggctgggaacccaacactgagcgtctctttgcacgagatggaatgctgctaggaaacaactttatggctctgaagttagaaggaggcggtcactatttgtgtgaatttaaaactacttacaaggcaaagaagcctgtgaagatgccagggtatcactatgttgaccgcaaactggatgtaaccaatcacaacaaggattacacttcggttgagcagtgtgaaatttccattgcacgcaaacctgtggtcgcctaaggatctctccaaagcccgccgaaaggcgggcttttctgtgcgatgttgctgacagaggtgactacaaagatgacgacgataaagattacaaagacgatgacgataaggactataaagatgatgacgacaaataataacctgcaggagacatgactgttcctcagttcaagttgggcacttacgagaagaccggtcttgctagattctaatcaagaggatgtcagaatgccatttgcctgagagatgcaggcttcatttttgattacttttttatttgtaacctatatagtataggattttttttgtcattttgtttcttctcgtacgagcttgctcctgatcagcctatctcgcagctgatgaatatcttgtggtaggggtttgggaaaatcattcgagtttgatgtttttcttggtatttcccactcctcttcagagtacagaagattaagtgagaggatccttcagtaatgtcttgtttcttttgttgcagtggtgagccattttgacttcgtgaaagtttctttagaatagttgtttccagaggccaaacattccacccgtagtaaagtgcaagcgtaggaagaccaagactggcataaatcaggtataagtgtcgagcactggcaggtgatcttctgaaagtttctactagcagataagatccagtagtcatgcatatggcaacaatgtaccgtgtggatctaagaacgcgtcctactaaccttcgcattcgttggtccagtttgttgttatcgatcaacgtgacaaggttgtcgattccgcgtaagcatgcatacccaaggacgcctgttgcaattccaagtgagccagttccaacaatctttgtaatattagagcacttcattgtgttgcgcttgaaagtaaaatgcgaacaaattaagagataatctcgaaaccgcgacttcaaacgccaatatgatgtgcggcacacaataagcgttcatatccgctgggtgactttctcgctttaaaaaattatccgaaaaaatttttgacggctagctcagtcctaggtacgctagcattaaagaggagaaaatgactactcttgatgacacagcctacagatataggacatcagttccgggtgacgcagaggctatcgaagccttggacggttcattcactactgatacggtgtttagagtcaccgctacaggtgatggcttcaccttgagagaggttcctgtagacccacccttaacgaaagttttccctgatgacgaatcggatgacgagtctgatgctggtgaggacggtgaccctgattccagaacatttgtcgcatacggagatgatggtgacctggctggctttgttgtggtgtcctacagcggatggaatcgtagactcacagttgaggacatcgaagttgcacctgaacatcgtggtcacggtgttggtcgtgcactgatgggactggcaacagagtttgctagagaaagaggagccggacatttgtggttagaagtgaccaatgtcaacgctcctgctattcacgcatataggcgaatgggtttcactttgtgcggtcttgatactgctttgtatgacggaactgcttctgatggtgaacaagctctttacatgagtatgccatgtccatagcacgtccgacggcggcccacgggtcccaggcctcggagatccgtcccccttttcctttgtcgatatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcaagctgcggccgcgcaaagttggtagatgtgacttccactgttgcttctggtataatccccattattgatgctcggcaattgactactgaatacgaactttctgaagatgtcaaaaagttccctgtcagtgaaattttgttggcgtctttgactactgaccgccccgatggtctattcactactttggtggctgactcttctaattactcgttgggcctggtgtactcgtccaaaaagtctattccggaggctataaggacacaaactggagtctaccaatctcgtcgtcacggtttgtggtataaaggtgctacatctggagcaactcaaaagttgctgggtatcgaattggattgtgatggagactgcttgaaatttgtggttgaacaaacaggtgttggtttctgtcacttggaacgcacttcctgttttggccaatcaaagggtcttagagccatggaagccaccttgtgggatcgtaagagcaatgctccagaaggttcttataccaaacggttatttgacgacgaagttttgttgaacgctaaaattagggaggaagctgatgaacttgcagaagctaaatccaaggaagatatagcctgggaatgtgctgacttattttattttgcattagttagatgtgccaagtacggtgtgacgttggacgaggtggagagaaacctggatatgaagtccctaaaggtcactagaaggaaaggagatgccaagccaggatacaccaaggaacaacctaaagaagaatccaaacctaaagaagtcccttctgaaggtcgtattgaattgtgcaaaattgacgtttctaaggcctcctcacaagaaattgaagatgcccttcgtcgtcctatagagaccttaattaagcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaagacgtcgtagactcctgaatgac

SEQ ID NO: 1400 - DNA, 6325 bp, Artificial Sequence
  Description of Artificial Sequence: Synthetic polynucleotide
tctagaggtctcacgttaggtcagtgatgacaatggaccaaattgttgcaaggtttttctttttctttcatcggcacatttcagcctcacatgcgactattatcgatcaatgaaatccatcaagattgaaatcttaaaattgcccctttcacttgacaggatccttttttgtagaaatgtcttggtgtcctcgtccaatcaggtagccatctctgaaatatctggctccgttgcaactccgaacgacctgctggcaacgtaaaattctccggggtaaaacttaaatgtggagtaatggaaccagaaacgtctcttcccttctctctccttccaccgcccgttaccgtccctaggaaattttactctgctggagagcttcttctacggcccccttgcagcaatgctcttcccagcattacgttgcgggtaaaacggaggtcgtgtacccgacctagcagcccagggatggaaaagtcccggccgtcgctggcaataatagcgggcggacgcatgtcatgagattattggaaaccaccagaatcgaatataaaaggcgaacacctttcccaattttggtttctcctgacccaaagactttaaatttaatttatttgtccctatttcaatcaattgaacaactatcaggcgcgccgaaacgatgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaaggtatcgctcatcgcgaaagtgaaacgtgatttcatgcgtcattttgaacattttgtaaatcttatttaataatgtgtgcggcaattcacatttaatttatgaatgttttcttaacatatcgcggcaactcaagaaacggcaggttcggatcttagctactagagattaaggaggtaaaaaaaatgagtgtgatcgctaaacaaatgacctacaaggtttatatgtcaggcacggtcaatggacactactttgaggtcgaaggtgatggaaaaggtaagccctacgagggggagcagacggtaaagctcactgtcaccaagggcggacctctgccatttgcttgggatattttatcaccacagtgtcagtacggaagcataccattcaccaagtaccctgaagatatccctgactatgtaaagcagtcattcccggagggctatacatgggagaggatcatgaactttgaagatggtgcagtgtgtactgtcagcaatgattccagcatccaaggcaactgtttcatctaccatgtcaagttctctggtttgaactttcctcccaatggacctgtcatgcagaagaaaacacagggctgggaacccaacactgagcgtctctttgcacgagatggaatgctgctaggaaacaactttatggctctgaagttagaaggaggcggtcactatttgtgtgaatttaaaactacttacaaggcaaagaagcctgtgaagatgccagggtatcactatgttgaccgcaaactggatgtaaccaatcacaacaaggattacacttcggttgagcagtgtgaaatttccattgcacgcaaacctgtggtcgcctaaggatctctccaaagcccgccgaaaggcgggcttttctgtgcgatgttgctgacagaggtgactacaaagatgacgacgataaagattacaaagacgatgacgataaggactataaagatgatgacgacaaataataacctgcaggagacatgactgttcctcagttcaagttgggcacttacgagaagaccggtcttgctagattctaatcaagaggatgtcagaatgccatttgcctgagagatgcaggcttcatttttgattacttttttatttgtaacctatatagtataggattttttttgtcattttgtttcttctcgtacgagcttgctcctgatcagcctatctcgcagctgatgaatatcttgtggtaggggtttgggaaaatcattcgagtttgatgtttttcttggtatttcccactcctcttcagagtacagaagattaagtgagaggatccttcagtaatgtcttgtttcttttgttgcagtggtgagccattttgacttcgtgaaagtttctttagaatagttgtttccagaggccaaacattccacccgtagtaaagtgcaagcgtaggaagaccaagactggcataaatcaggtataagtgtcgagcactggcaggtgatcttctgaaagtttctactagcagataagatccagtagtcatgcatatggcaacaatgtaccgtgtggatctaagaacgcgtcctactaaccttcgcattcgttggtccagtttgttgttatcgatcaacgtgacaaggttgtcgattccgcgtaagcatgcatacccaaggacgcctgttgcaattccaagtgagccagttccaacaatctttgtaatattagagcacttcattgtgttgcgcttgaaagtaaaatgcgaacaaattaagagataatctcgaaaccgcgacttcaaacgccaatatgatgtgcggcacacaataagcgttcatatccgctgggtgactttctcgctttaaaaaattatccgaaaaaatttttgacggctagctcagtcctaggtacgctagcattaaagaggagaaaatgactactcttgatgacacagcctacagatataggacatcagttccgggtgacgcagaggctatcgaagccttggacggttcattcactactgatacggtgtttagagtcaccgctacaggtgatggcttcaccttgagagaggttcctgtagacccacccttaacgaaagttttccctgatgacgaatcggatgacgagtctgatgctggtgaggacggtgaccctgattccagaacatttgtcgcatacggagatgatggtgacctggctggctttgttgtggtgtcctacagcggatggaatcgtagactcacagttgaggacatcgaagttgcacctgaacatcgtggtcacggtgttggtcgtgcactgatgggactggcaacagagtttgctagagaaagaggagccggacatttgtggttagaagtgaccaatgtcaacgctcctgctattcacgcatataggcgaatgggtttcactttgtgcggtcttgatactgctttgtatgacggaactgcttctgatggtgaacaagctctttacatgagtatgccatgtccatagcacgtccgacggcggcccacgggtcccaggcctcggagatccgtcccccttttcctttgtcgatatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcaagctggtaccactcaatcccgactgtcaatcattcatccttgcgtcttttgaacatctatgcttccacaagtcaattcttgatttagtatacacataaccaaatttggatcaagtttgaagtaaaactttaacttcagctccttacatttgcactaagatctctgctactctggtcccaagtgaaccaccttttggaccctattgaccggaccttaacttgccaaacctaaacgcttaatgcctcagacgttttaatgcctctcaacacctccaaggttgctttcttgagcatgcctactaggaactttaacgaactgtggggttgcagacagtttcaggcgtgtcccgaccaatatggcctactagactctctgaaaaatcacagttttccagtagttccgatcaaattaccatcgaaatggtcccataaacggacatttgacatccgttcctgaattatagtcttccaccgtggatcatggtgttcctttttttcccaaagaatatcagcatcccttaactacgttagagaccgaattcgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaagacgtcccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggtgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataactgtcagaccaagtttactcatatatactttagattgatttaaaacttcatttttaatttaaaaggatctaggtgaagatcctt

SEQ ID NO: 1401 - DNA, 6983 bp, Artificial Sequence
  Description of Artificial Sequence: Synthetic polynucleotide
tctagaggtctcacgttaggtcagtgatgacaatggaccaaattgttgcaaggtttttctttttctttcatcggcacatttcagcctcacatgcgactattatcgatcaatgaaatccatcaagattgaaatcttaaaattgcccctttcacttgacaggatccttttttgtagaaatgtcttggtgtcctcgtccaatcaggtagccatctctgaaatatctggctccgttgcaactccgaacgacctgctggcaacgtaaaattctccggggtaaaacttaaatgtggagtaatggaaccagaaacgtctcttcccttctctctccttccaccgcccgttaccgtccctaggaaattttactctgctggagagcttcttctacggcccccttgcagcaatgctcttcccagcattacgttgcgggtaaaacggaggtcgtgtacccgacctagcagcccagggatggaaaagtcccggccgtcgctggcaataatagcgggcggacgcatgtcatgagattattggaaaccaccagaatcgaatataaaaggcgaacacctttcccaattttggtttctcctgacccaaagactttaaatttaatttatttgtccctatttcaatcaattgaacaactatcaggcgcgccaggtgaaacgatgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagctgatgcacacaaatccgaagtcgcacacagattcaaagatttgggtgaggaaaactttaaggctttggtccttattgcttttgcccagtacttacagcaatgtccattcgaggatcatgtcaaactggttaatgaggttacagagttcgccaagacttgtgttgctgatgagtccgcagaaaactgcgataaaagtctgcacactttgtttggtgacaaattgtgtactgttgccacactcagagaaacttacggagagatggctgattgttgtgcaaaacaagagcctgagagaaacgaatgttttctgcaacataaagatgataaccccaatctacctcgtttggttagacctgaagtggacgttatgtgtactgcttttcacgataacgaggaaactttcctgaaaaagtacttatatgaaatcgcaaggagacatccctacttctatgcaccagaactgttgtttttcgctaaaaggtacaaagcagcattcacagaatgttgtcaagccgctgacaaggctgcttgtctgttgcccaaattggatgagttgcgtgacgaaggtaaggcctcttcagccaagcaaagacttaagtgcgcaagtttgcagaaatttggtgaacgtgctttcaaggcttgggctgtagcaagattatcgcaaagattccctaaagctgagttcgcagaggtttccaaacttgttactgacttgacaaaagttcatacggaatgttgccacggtgacttgcttgaatgtgctgatgaccgtgctgatctagcaaaatacatctgtgaaaatcaagactctatctcatccaagttaaaggagtgttgcgaaaaacctttgctagaaaagtcacattgcatagctgaggttgaaaatgatgaaatgccagcagaccttccttcactggctgctgattttgtagaatctaaagacgtttgcaagaattacgctgaagctaaggacgttttccttggcatgtttctgtatgaatatgctcgtagacatccagactattctgttgtgctgcttttaagactggctaagacttatgaaacgaccttagaaaagtgttgtgccgctgctgacccacacgagtgttatgcaaaagtctttgacgagttcaagccattggtcgaggagcctcagaacttgattaaacaaaattgtgaactgtttgaacaattgggagagtacaagttccaaaacgcactgcttgtaagatacaccaaaaaggttccacaggtttcgacaccaacattagtggaagtttcccgtaatctgggtaaagtcggatcgaagtgttgtaagcatcctgaggctaaaaggatgccatgtgccgaagattacttgtccgtcgtgttgaatcaattgtgcgtgttgcatgagaaaacaccggtgagcgacagggttaccaaatgttgcactgagagcctagtcaatagaaggccatgtttctctgccttagaggtggacgaaacttatgtccccaaggagtttaatgcagagacttttaccttccatgcagatatttgcacactctccgagaaagagcgacagatcaaaaagcaaacggctctggtggaattggtgaaacacaaacctaaggccacaaaggagcaacttaaggctgtgatggatgatttcgcagcctttgtagagaaatgttgtaaggctgatgacaaggaaacatgctttgcagaggaaggaaagaaattggtagctgctagccaggctgcattgggtttggactacaaagatgacgacgataaagattacaaagacgatgacgataaggactataaagatgatgacgacaaataataaggtcctgcaggagacatgactgttcctcagttcaagttgggcacttacgagaagaccggtcttgctagattctaatcaagaggatgtcagaatgccatttgcctgagagatgcaggcttcatttttgattacttttttatttgtaacctatatagtataggattttttttgtcattttgtttcttctcgtacgagcttgctcctgatcagcctatctcgcagctgatgaatatcttgtggtaggggtttgggaaaatcattcgagtttgatgtttttcttggtatttcccactcctcttcagagtacagaagattaagtgagaggatccttcagtaatgtcttgtttcttttgttgcagtggtgagccattttgacttcgtgaaagtttctttagaatagttgtttccagaggccaaacattccacccgtagtaaagtgcaagcgtaggaagaccaagactggcataaatcaggtataagtgtcgagcactggcaggtgatcttctgaaagtttctactagcagataagatccagtagtcatgcatatggcaacaatgtaccgtgtggatctaagaacgcgtcctactaaccttcgcattcgttggtccagtttgttgttatcgatcaacgtgacaaggttgtcgattccgcgtaagcatgcatacccaaggacgcctgttgcaattccaagtgagccagttccaacaatctttgtaatattagagcacttcattgtgttgcgcttgaaagtaaaatgcgaacaaattaagagataatctcgaaaccgcgacttcaaacgccaatatgatgtgcggcacacaataagcgttcatatccgctgggtgactttctcgctttaaaaaattatccgaaaaaatttttgacggctagctcagtcctaggtacgctagcattaaagaggagaaaatggctaaactgacctctgctgttccggttctgaccgctcgtgacgttgctggtgctgttgagttctggaccgaccgtctgggtttctctcgtgacttcgttgaagacgacttcgctggtgttgttcgtgacgacgttaccctgttcatctctgctgttcaggaccaggttgttccggacaacaccctggcttgggtttgggttcgtggtctggacgaactgtacgctgaatggtctgaagttgtttctaccaacttccgtgacgcttctggtccggctatgaccgaaatcggtgaacagccgtggggtcgtgagttcgctctgcgtgacccggctggtaactgcgttcacttcgttgctgaagaacaggactaacacgtccgacggcggcccacgggtcccaggcctcggagatccgtcccccttttcctttgtcgatatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcaagctggtaccactcaatcccgactgtcaatcattcatccttgcgtcttttgaacatctatgcttccacaagtcaattcttgatttagtatacacataaccaaatttggatcaagtttgaagtaaaactttaacttcagctccttacatttgcactaagatctctgctactctggtcccaagtgaaccaccttttggaccctattgaccggaccttaacttgccaaacctaaacgcttaatgcctcagacgttttaatgcctctcaacacctccaaggttgctttcttgagcatgcctactaggaactttaacgaactgtggggttgcagacagtttcaggcgtgtcccgaccaatatggcctactagactctctgaaaaatcacagttttccagtagttccgatcaaattaccatcgaaatggtcccataaacggacatttgacatccgttcctgaattatagtcttccaccgtggatcatggtgttcctttttttcccaaagaatatcagcatcccttaactacgttagagaccgaattcgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaagacgtcccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggtgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataactgtcagaccaagtttactcatatatactttagattgatttaaaacttcatttttaatttaaaaggatctaggtgaagatcctt

SEQ ID NO: 1402 - DNA, 3944 bp, Artificial Sequence
  Description of Artificial Sequence: Synthetic polynucleotide
ggcgcgcctatgcgatggtctcaaggtgaaagtgaaacgtgatttcatgcgtcattttgaacattttgtaaatcttatttaataatgtgtgcggcaattcacatttaatttatgaatgttttcttaacatatcgcggcaactcaagaaacggcaggttcggatcttagctactagagattaaggaggtaaaaaaaatgagtgtgatcgctaaacaaatgacctacaaggtttatatgtcaggcacggtcaatggacactactttgaggtcgaaggtgatggaaaaggtaagccctacgagggggagcagacggtaaagctcactgtcaccaagggcggacctctgccatttgcttgggatattttatcaccacagtgtcagtacggaagcataccattcaccaagtaccctgaagatatccctgactatgtaaagcagtcattcccggagggctatacatgggagaggatcatgaactttgaagatggtgcagtgtgtactgtcagcaatgattccagcatccaaggcaactgtttcatctaccatgtcaagttctctggtttgaactttcctcccaatggacctgtcatgcagaagaaaacacagggctgggaacccaacactgagcgtctctttgcacgagatggaatgctgctaggaaacaactttatggctctgaagttagaaggaggcggtcactatttgtgtgaatttaaaactacttacaaggcaaagaagcctgtgaagatgccagggtatcactatgttgaccgcaaactggatgtaaccaatcacaacaaggattacacttcggttgagcagtgtgaaatttccattgcacgcaaacctgtggtcgcctaaggatctctccaaagcccgccgaaaggcgggcttttctgtaggtacgtcttcatcgctatcctgcaggcggatatcttcggaaaaaaaaaggcctgcgattaccagcaggcctgttgagatcgaggaaatctcgggatctagtcttgagctttgctcactcaaaggcggtaatgcggccgctagaaatattttatctgattaataagatgatcttcttgagatcgttttggtctgcgcgtaatctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgccaacatagtaagccagtatacactccgctagcgctgatgtccggcggtgcggtaccttgatcgggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatccctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcacgatgggcaaatattatacgcaaggcgacaaggtgctgatgccgctggcgattcaggttcatcatgccgtttgtgatggcttccatgtcggcagaatgcttaatgaattacaacagtactgtgatgagtggcagggcggggcgtaatttgatatcgagctcgcttggactcctgttgatagatccagtaatgacctcagaactccatctggatttgttcagaacgctcggttgccgccgggcgttttttattggtgagaatccaagcctctctagacttgaagactgacgtcgagacctacgaattcctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctccaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggagctagttcatgaccaaaatcccttaacgctcgaggtatcacgaggcagaatttcagataaaaaaaatccttagctttcgctaaggat

SEQ ID NO: 1403 - DNA, 4130 bp, Artificial Sequence
  Description of Artificial Sequence: Synthetic polynucleotide
ggcgcgcctatgcgatggtctcaaggtgaaagtgaaacgtgatttcatgcgtcattttgaacattttgtaaatcttatttaataatgtgtgcggcaattcacatttaatttatgaatgttttcttaacatatcgcggcaactcaagaaacggcaggttcggatcttagctactagagattaaggaggtaaaaaaaatgagtgtgatcgctaaacaaatgacctacaaggtttatatgtcaggcacggtcaatggacactactttgaggtcgaaggtgatggaaaaggtaagccctacgagggggagcagacggtaaagctcactgtcaccaagggcggacctctgccatttgcttgggatattttatcaccacagtgtcagtacggaagcataccattcaccaagtaccctgaagatatccctgactatgtaaagcagtcattcccggagggctatacatgggagaggatcatgaactttgaagatggtgcagtgtgtactgtcagcaatgattccagcatccaaggcaactgtttcatctaccatgtcaagttctctggtttgaactttcctcccaatggacctgtcatgcagaagaaaacacagggctgggaacccaacactgagcgtctctttgcacgagatggaatgctgctaggaaacaactttatggctctgaagttagaaggaggcggtcactatttgtgtgaatttaaaactacttacaaggcaaagaagcctgtgaagatgccagggtatcactatgttgaccgcaaactggatgtaaccaatcacaacaaggattacacttcggttgagcagtgtgaaatttccattgcacgcaaacctgtggtcgcctaaggatctctccaaagcccgccgaaaggcgggcttttctgtaggtacgtcttcatcgctatcctgcaggcggatatcttcggaaaaaaaaaggcctgcgattaccagcaggcctgttgagatcgaggaaatctcgggatctagtcttgagctttgctcactcaaaggcggtaatgcggccgctagaaatattttatctgattaataagatgatcttcttgagatcgttttggtctgcgcgtaatctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgccaacatagtaagccagtatacactccgctagcgctgatgtccggcggtgcggtaccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtcgcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttctagacttgaagactgacgtcgagacctacgaattcctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctccaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggagctagttcatgaccaaaatcccttaacgctcgaggtatcacgaggcagaatttcagataaaaaaaatccttagctttcgctaaggat

SEQ ID NO: 1404 - DNA, 3971 bp, Artificial Sequence
  Description of Artificial Sequence: Synthetic polynucleotide
ggcgcgcctatgcgatggtctcaaggtgaaagtgaaacgtgatttcatgcgtcattttgaacattttgtaaatcttatttaataatgtgtgcggcaattcacatttaatttatgaatgttttcttaacatatcgcggcaactcaagaaacggcaggttcggatcttagctactagagattaaggaggtaaaaaaaatgagtgtgatcgctaaacaaatgacctacaaggtttatatgtcaggcacggtcaatggacactactttgaggtcgaaggtgatggaaaaggtaagccctacgagggggagcagacggtaaagctcactgtcaccaagggcggacctctgccatttgcttgggatattttatcaccacagtgtcagtacggaagcataccattcaccaagtaccctgaagatatccctgactatgtaaagcagtcattcccggagggctatacatgggagaggatcatgaactttgaagatggtgcagtgtgtactgtcagcaatgattccagcatccaaggcaactgtttcatctaccatgtcaagttctctggtttgaactttcctcccaatggacctgtcatgcagaagaaaacacagggctgggaacccaacactgagcgtctctttgcacgagatggaatgctgctaggaaacaactttatggctctgaagttagaaggaggcggtcactatttgtgtgaatttaaaactacttacaaggcaaagaagcctgtgaagatgccagggtatcactatgttgaccgcaaactggatgtaaccaatcacaacaaggattacacttcggttgagcagtgtgaaatttccattgcacgcaaacctgtggtcgcctaaggatctctccaaagcccgccgaaaggcgggcttttctgtaggtacgtcttcatcgctatcctgcaggcggatatcttcggaaaaaaaaaggcctgcgattaccagcaggcctgttgagatcgaggaaatctcgggatctagtcttgagctttgctcactcaaaggcggtaatgcggccgctagaaatattttatctgattaataagatgatcttcttgagatcgttttggtctgcgcgtaatctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgccaacatagtaagccagtatacactccgctagcgctgatgtccggcggtgcggtaccttgatcgggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatccctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcacgatgggcaaatattatacgcaaggcgacaaggtgctgatgccgctggcgattcaggttcatcatgccgtttgtgatggcttccatgtcggcagaatgcttaatgaattacaacagtactgtgatgagtggcagggcggggcgtaatttgatatcgagctcgcttggactcctgttgatagatccagtaatgacctcagaactccatctggatttgttcagaacgctcggttgccgccgggcgttttttattggtgagaatccaagcctctctagacttgaagactgacgtcgagacctacgaattcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtcgcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatccttctcgaggtatcacgaggcagaatttcagataaaaaaaatccttagctttcgctaaggat

SEQ ID NO: 1405 - DNA, 4130 bp, Artificial Sequence
  Description of Artificial Sequence: Synthetic polynucleotide
ggcgcgcctatgcgatggtctcaaggtgaaagtgaaacgtgatttcatgcgtcattttgaacattttgtaaatcttatttaataatgtgtgcggcaattcacatttaatttatgaatgttttcttaacatatcgcggcaactcaagaaacggcaggttcggatcttagctactagagattaaggaggtaaaaaaaatgagtgtgatcgctaaacaaatgacctacaaggtttatatgtcaggcacggtcaatggacactactttgaggtcgaaggtgatggaaaaggtaagccctacgagggggagcagacggtaaagctcactgtcaccaagggcggacctctgccatttgcttgggatattttatcaccacagtgtcagtacggaagcataccattcaccaagtaccctgaagatatccctgactatgtaaagcagtcattcccggagggctatacatgggagaggatcatgaactttgaagatggtgcagtgtgtactgtcagcaatgattccagcatccaaggcaactgtttcatctaccatgtcaagttctctggtttgaactttcctcccaatggacctgtcatgcagaagaaaacacagggctgggaacccaacactgagcgtctctttgcacgagatggaatgctgctaggaaacaactttatggctctgaagttagaaggaggcggtcactatttgtgtgaatttaaaactacttacaaggcaaagaagcctgtgaagatgccagggtatcactatgttgaccgcaaactggatgtaaccaatcacaacaaggattacacttcggttgagcagtgtgaaatttccattgcacgcaaacctgtggtcgcctaaggatctctccaaagcccgccgaaaggcgggcttttctgtaggtacgtcttcatcgctatcctgcaggcggatatcttcggaaaaaaaaaggcctgcgattaccagcaggcctgttgagatcgaggaaatctcgggatctagtcttgagctttgctcactcaaaggcggtaatgcggccgctagaaatattttatctgattaataagatgatcttcttgagatcgttttggtctgcgcgtaatctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgccaacatagtaagccagtatacactccgctagcgctgatgtccggcggtgcggtaccctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctccaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggagctagttcatgaccaaaatcccttaacgtctagacttgaagactgacgtcgagacctacgaattcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtcgcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatccttctcgaggtatcacgaggcagaatttcagataaaaaaaatccttagctttcgctaaggat

SEQ ID NO: 1406 - DNA, 3971 bp, Artificial Sequence
  Description of Artificial Sequence: Synthetic polynucleotide
ggcgcgcctatgcgatggtctcaaggtgaaagtgaaacgtgatttcatgcgtcattttgaacattttgtaaatcttatttaataatgtgtgcggcaattcacatttaatttatgaatgttttcttaacatatcgcggcaactcaagaaacggcaggttcggatcttagctactagagattaaggaggtaaaaaaaatgagtgtgatcgctaaacaaatgacctacaaggtttatatgtcaggcacggtcaatggacactactttgaggtcgaaggtgatggaaaaggtaagccctacgagggggagcagacggtaaagctcactgtcaccaagggcggacctctgccatttgcttgggatattttatcaccacagtgtcagtacggaagcataccattcaccaagtaccctgaagatatccctgactatgtaaagcagtcattcccggagggctatacatgggagaggatcatgaactttgaagatggtgcagtgtgtactgtcagcaatgattccagcatccaaggcaactgtttcatctaccatgtcaagttctctggtttgaactttcctcccaatggacctgtcatgcagaagaaaacacagggctgggaacccaacactgagcgtctctttgcacgagatggaatgctgctaggaaacaactttatggctctgaagttagaaggaggcggtcactatttgtgtgaatttaaaactacttacaaggcaaagaagcctgtgaagatgccagggtatcactatgttgaccgcaaactggatgtaaccaatcacaacaaggattacacttcggttgagcagtgtgaaatttccattgcacgcaaacctgtggtcgcctaaggatctctccaaagcccgccgaaaggcgggcttttctgtaggtacgtcttcatcgctatcctgcaggcggatatcttcggaaaaaaaaaggcctgcgattaccagcaggcctgttgagatcgaggaaatctcgggatctagtcttgagctttgctcactcaaaggcggtaatgcggccgctagaaatattttatctgattaataagatgatcttcttgagatcgttttggtctgcgcgtaatctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgccaacatagtaagccagtatacactccgctagcgctgatgtccggcggtgcggtaccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtcgcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttctagacttgaagactgacgtcgagacctacgaattcttgatcgggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatccctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcacgatgggcaaatattatacgcaaggcgacaaggtgctgatgccgctggcgattcaggttcatcatgccgtttgtgatggcttccatgtcggcagaatgcttaatgaattacaacagtactgtgatgagtggcagggcggggcgtaatttgatatcgagctcgcttggactcctgttgatagatccagtaatgacctcagaactccatctggatttgttcagaacgctcggttgccgccgggcgttttttattggtgagaatccaagcctcctcgaggtatcacgaggcagaatttcagataaaaaaaatccttagctttcgctaaggat

SEQ ID NO: 1407 - DNA, 3944 bp, Artificial Sequence
  Description of Artificial Sequence: Synthetic polynucleotide
ggcgcgcctatgcgatggtctcaaggtgaaagtgaaacgtgatttcatgcgtcattttgaacattttgtaaatcttatttaataatgtgtgcggcaattcacatttaatttatgaatgttttcttaacatatcgcggcaactcaagaaacggcaggttcggatcttagctactagagattaaggaggtaaaaaaaatgagtgtgatcgctaaacaaatgacctacaaggtttatatgtcaggcacggtcaatggacactactttgaggtcgaaggtgatggaaaaggtaagccctacgagggggagcagacggtaaagctcactgtcaccaagggcggacctctgccatttgcttgggatattttatcaccacagtgtcagtacggaagcataccattcaccaagtaccctgaagatatccctgactatgtaaagcagtcattcccggagggctatacatgggagaggatcatgaactttgaagatggtgcagtgtgtactgtcagcaatgattccagcatccaaggcaactgtttcatctaccatgtcaagttctctggtttgaactttcctcccaatggacctgtcatgcagaagaaaacacagggctgggaacccaacactgagcgtctctttgcacgagatggaatgctgctaggaaacaactttatggctctgaagttagaaggaggcggtcactatttgtgtgaatttaaaactacttacaaggcaaagaagcctgtgaagatgccagggtatcactatgttgaccgcaaactggatgtaaccaatcacaacaaggattacacttcggttgagcagtgtgaaatttccattgcacgcaaacctgtggtcgcctaaggatctctccaaagcccgccgaaaggcgggcttttctgtaggtacgtcttcatcgctatcctgcaggcggatatcttcggaaaaaaaaaggcctgcgattaccagcaggcctgttgagatcgaggaaatctcgggatctagtcttgagctttgctcactcaaaggcggtaatgcggccgctagaaatattttatctgattaataagatgatcttcttgagatcgttttggtctgcgcgtaatctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgccaacatagtaagccagtatacactccgctagcgctgatgtccggcggtgcggtaccctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctccaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggagctagttcatgaccaaaatcccttaacgtctagacttgaagactgacgtcgagacctacgaattcttgatcgggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatccctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcacgatgggcaaatattatacgcaaggcgacaaggtgctgatgccgctggcgattcaggttcatcatgccgtttgtgatggcttccatgtcggcagaatgcttaatgaattacaacagtactgtgatgagtggcagggcggggcgtaatttgatatcgagctcgcttggactcctgttgatagatccagtaatgacctcagaactccatctggatttgttcagaacgctcggttgccgccgggcgttttttattggtgagaatccaagcctcctcgaggtatcacgaggcagaatttcagataaaaaaaatccttagctttcgctaaggat

SEQ ID NO: 1408 - DNA, 3324 bp, Artificial Sequence
  Description of Artificial Sequence: Synthetic polynucleotide
ggcgcgccgaaacgatgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtacgtcttcatcgctatcctgcaggcggatatcttcggaaaaaaaaaggcctgcgattaccagcaggcctgttgagatcgaggaaatctcgggatctagtcttgagctttgctcactcaaaggcggtaatgcggccgctagaaatattttatctgattaataagatgatcttcttgagatcgttttggtctgcgcgtaatctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgccaacatagtaagccagtatacactccgctagcgctgatgtccggcggtgcggtaccttgatcgggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatccctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcacgatgggcaaatattatacgcaaggcgacaaggtgctgatgccgctggcgattcaggttcatcatgccgtttgtgatggcttccatgtcggcagaatgcttaatgaattacaacagtactgtgatgagtggcagggcggggcgtaatttgatatcgagctcgcttggactcctgttgatagatccagtaatgacctcagaactccatctggatttgttcagaacgctcggttgccgccgggcgttttttattggtgagaatccaagcctctctagacttgaagactgacgtcgagacctacgaattcctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctccaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggagctagttcatgaccaaaatcccttaacgctcgaggtatcacgaggcagaatttcagataaaaaaaatccttagctttcgctaaggat

SEQ ID NO: 1409 - protein, 25 aa, Artificial Sequence
  Description of Artificial Sequence: Synthetic peptide
GDYKDDDDKDYKDDDDKDYKDDDDK

SEQ ID NO: 1410 - DNA, 81 bp, Artificial Sequence
  Description of Artificial Sequence: Synthetic oligonucleotide
ggtgactacaaagatgacgacgataaagattacaaagacgatgacgataaggactataaagatgatgacgacaaataataa

SEQ ID NO: 1411 - protein, 798 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGVLNAGNASALAGSFARALSASAESQSFAQSQAYQQASAFQQAAAQSAAQSASRAGSTSSSTTTTTSGATSQAASQSASSSYSSAFAQAASSSLATSSAISRAFASVSSASAASSLAYNIGLSAARSLGIASDTALAGALAQAVGGVGAGASASAYANAIARAAGQFLATQGVLNAGNASALAGSFARALSASAESQSFAQSQAYQQASAFQQAAAQSAAQSASRAGSTSSSTTTTTSGATSQAASQSASSSYSSAFAQAASSSLATSSAISRAFASVSSASAASSLAYNIGLSAARSLGIASDTALAGALAQAVGGVGAGASASAYANAIARAAGQFLATQGVLNAGNASALAGSFARALSASAESQSFAQSQAYQQASAFQQAAAQSAAQSASRAGSTSSSTTTTTSGATSQAASQSASSSYSSAFAQAASSSLATSSAISRAFASVSSASAASSLAYNIGLSAARSLGIASDTALAGALAQAVGGVGAGASASAYANAIARAAGQFLATQGVLNAGNASALAGSFARALSASAESQSFAQSQAYQQASAFQQAAAQSAAQSASRAGSTSSSTTTTTSGATSQAASQSASSSYSSAFAQAASSSLATSSAISRAFASVSSASAASSLAYNIGLSAARSLGIASDTALAGALAQAVGGVGAGASASAYANAIARAAGQFLATQGDYKDDDDKDYKDDDDKDYKDDDDK

SEQ ID NO: 1412 - protein, 946 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGINVDSDIGSVTSLILSGSTLQMTIPAGGDDLSGGYPGGFPAGAQPSGGAPVDFGGPSAGGDVAAKLARSLASTLASSGVFRAAFNSRVSTPVAVQFTDALVQKIASNLGLDYATASKLRKASQAVSKVRMGSDTNAYALAISSALAEVLSSSGKVADANINQIAPQLASGIVLGVSTTAPQFGVDLSSINVNLDISNVARNMQASIQGINVDSDIGSVTSLILSGSTLQMTIPAGGDDLSGGYPGGFPAGAQPSGGAPVDFGGPSAGGDVAAKLARSLASTLASSGVFRAAFNSRVSTPVAVQFTDALVQKIASNLGLDYATASKLRKASQAVSKVRMGSDTNAYALAISSALAEVLSSSGKVADANINQIAPQLASGIVLGVSTTAPQFGVDLSSINVNLDISNVARNMQASIQGINVDSDIGSVTSLILSGSTLQMTIPAGGDDLSGGYPGGFPAGAQPSGGAPVDFGGPSAGGDVAAKLARSLASTLASSGVFRAAFNSRVSTPVAVQFTDALVQKIASNLGLDYATASKLRKASQAVSKVRMGSDTNAYALAISSALAEVLSSSGKVADANINQIAPQLASGIVLGVSTTAPQFGVDLSSINVNLDISNVARNMQASIQGINVDSDIGSVTSLILSGSTLQMTIPAGGDDLSGGYPGGFPAGAQPSGGAPVDFGGPSAGGDVAAKLARSLASTLASSGVFRAAFNSRVSTPVAVQFTDALVQKIASNLGLDYATASKLRKASQAVSKVRMGSDTNAYALAISSALAEVLSSSGKVADANINQIAPQLASGIVLGVSTTAPQFGVDLSSINVNLDISNVARNMQASIQGDYKDDDDKDYKDDDDKDYKDDDDK

SEQ ID NO: 1413 - protein, 790 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGAAATSSSTSGASASSISSTTASSSSTGASSAAAGASHGAASAGGAFDFTRALFSELLESKIFSATTANFHSSTTASETLYATILKCLRELHFRYDECLQGATEVVSDLSVVSVGSGVHNYARVIAAFFERFFRKHDIPLSANYASRVAQYLISAMGSSVASADASSSSGAAATSSSTSGASASSISSTTASSSSTGASSAAAGASHGAASAGGAFDFTRALFSELLESKIFSATTANFHSSTTASETLYATILKCLRELHFRYDECLQGATEVVSDLSVVSVGSGVHNYARVIAAFFERFFRKHDIPLSANYASRVAQYLISAMGSSVASADASSSSGAAATSSSTSGASASSISSTTASSSSTGASSAAAGASHGAASAGGAFDFTRALFSELLESKIFSATTANFHSSTTASETLYATILKCLRELHFRYDECLQGATEVVSDLSVVSVGSGVHNYARVIAAFFERFFRKHDIPLSANYASRVAQYLISAMGSSVASADASSSSGAAATSSSTSGASASSISSTTASSSSTGASSAAAGASHGAASAGGAFDFTRALFSELLESKIFSATTANFHSSTTASETLYATILKCLRELHFRYDECLQGATEVVSDLSVVSVGSGVHNYARVIAAFFERFFRKHDIPLSANYASRVAQYLISAMGSSVASADASSSSGDYKDDDDKDYKDDDDKDYKDDDDK

SEQ ID NO: 1414 - protein, 978 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGAGAGGAGGYAQGYGAGAGAGAGAGTGAGGAGGYGQGYGAGSGAGAGGAGGYGAGAGAGAGAGDASGYGQGYGDGAGAGAGAAAAAGAAAGARGAGGYGGGAGAGAGAGAGAAGGYGQGYGAGAGEGAGAGAGAGAVAGAGAAAAAGAGAGAGGAEGYGAGAGAGGAGGYGQSYGDGAAAAAGSGAGAGGSGGYGAGAGAGSGAGAAGGYGGGAGAGAGAGGAGGYAQGYGAGAGAGAGAGTGAGGAGGYGQGYGAGSGAGAGGAGGYGAGAGAGAGAGDASGYGQGYGDGAGAGAGAAAAAGAAAGARGAGGYGGGAGAGAGAGAGAAGGYGQGYGAGAGEGAGAGAGAGAVAGAGAAAAAGAGAGAGGAEGYGAGAGAGGAGGYGQSYGDGAAAAAGSGAGAGGSGGYGAGAGAGSGAGAAGGYGGGAGAGAGAGGAGGYAQGYGAGAGAGAGAGTGAGGAGGYGQGYGAGSGAGAGGAGGYGAGAGAGAGAGDASGYGQGYGDGAGAGAGAAAAAGAAAGARGAGGYGGGAGAGAGAGAGAAGGYGQGYGAGAGEGAGAGAGAGAVAGAGAAAAAGAGAGAGGAEGYGAGAGAGGAGGYGQSYGDGAAAAAGSGAGAGGSGGYGAGAGAGSGAGAAGGYGGGAGAGAGAGGAGGYAQGYGAGAGAGAGAGTGAGGAGGYGQGYGAGSGAGAGGAGGYGAGAGAGAGAGDASGYGQGYGDGAGAGAGAAAAAGAAAGARGAGGYGGGAGAGAGAGAGAAGGYGQGYGAGAGEGAGAGAGAGAVAGAGAAAAAGAGAGAGGAEGYGAGAGAGGAGGYGQSYGDGAAAAAGSGAGAGGSGGYGAGAGAGSGAGAAGGYGGGAGAGDYKDDDDKDYKDDDDKDYKDDDDK

SEQ ID NO: 1415 - protein, 974 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGSSAGLVSRVANALANTSTLRAVLRRGVSQQTASSVVQRAVQSLAGTLGVDGNSLSRIALQAISQLPGGSDTSAYAQAFSSALFNAGVLNASNIDTLGSRVLSAVLNGVSSAAQGIGLNVDTGSVQSDISSSSSFLSSSSSSASFSQTSASSTSGAGYTAPAGPSGYTGPSGPSGYTGPVGGAAQFGSVSGQTSFGQTSGFTASTGGQAAFGATSGSSAGLVSRVANALANTSTLRAVLRRGVSQQTASSVVQRAVQSLAGTLGVDGNSLSRIALQAISQLPGGSDTSAYAQAFSSALFNAGVLNASNIDTLGSRVLSAVLNGVSSAAQGIGLNVDTGSVQSDISSSSSFLSSSSSSASFSQTSASSTSGAGYTAPAGPSGYTGPSGPSGYTGPVGGAAQFGSVSGQTSFGQTSGFTASTGGQAAFGATSGSSAGLVSRVANALANTSTLRAVLRRGVSQQTASSVVQRAVQSLAGTLGVDGNSLSRIALQAISQLPGGSDTSAYAQAFSSALFNAGVLNASNIDTLGSRVLSAVLNGVSSAAQGIGLNVDTGSVQSDISSSSSFLSSSSSSASFSQTSASSTSGAGYTAPAGPSGYTGPSGPSGYTGPVGGAAQFGSVSGQTSFGQTSGFTASTGGQAAFGATSGSSAGLVSRVANALANTSTLRAVLRRGVSQQTASSVVQRAVQSLAGTLGVDGNSLSRIALQAISQLPGGSDTSAYAQAFSSALFNAGVLNASNIDTLGSRVLSAVLNGVSSAAQGIGLNVDTGSVQSDISSSSSFLSSSSSSASFSQTSASSTSGAGYTAPAGPSGYTGPSGPSGYTGPVGGAAQFGSVSGQTSFGQTSGFTASTGGQAAFGATSGDYKDDDDKDYKDDDDKDYKDDDDK

SEQ ID NO: 1416 - protein, 834 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGSLASSFASALSASAASVASSAAAQAASQSQAAASAFSRAASQSASQSAARSGAQSSSTTTTTSTAGSQAASQFASSAASQASASSFARASSASLAASSSFSSAFSSANSLSALGNVGYQLGFNVANNLGISNAAGLGNALSQAVSSVGVGASSSSYANAVSNAVGQFLAGQGILNAANAGSLASSFASALSASAASVASSAAAQAASQSQAAASAFSRAASQSASQSAARSGAQSSSTTTTTSTAGSQAASQFASSAASQASASSFARASSASLAASSSFSSAFSSANSLSALGNVGYQLGFNVANNLGISNAAGLGNALSQAVSSVGVGASSSSYANAVSNAVGQFLAGQGILNAANAGSLASSFASALSASAASVASSAAAQAASQSQAAASAFSRAASQSASQSAARSGAQSSSTTTTTSTAGSQAASQFASSAASQASASSFARASSASLAASSSFSSAFSSANSLSALGNVGYQLGFNVANNLGISNAAGLGNALSQAVSSVGVGASSSSYANAVSNAVGQFLAGQGILNAANAGSLASSFASALSASAASVASSAAAQAASQSQAAASAFSRAASQSASQSAARSGAQSSSTTTTTSTAGSQAASQFASSAASQASASSFARASSASLAASSSFSSAFSSANSLSALGNVGYQLGFNVANNLGISNAAGLGNALSQAVSSVGVGASSSSYANAVSNAVGQFLAGQGILNAANAGDYKDDDDKDYKDDDDKDYKDDDDK

SEQ ID NO: 1417 - protein, 830 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGASSTTTATSESGITASSVATGAAAAISKTAAGSSSITYLARSFSRSLVSYLLQSAEFHSVFYSGISSGIASHIASTAGTSTAESLDLASLKSVIATACGKAMAATNSDGGPHAFANSLGSAITAVLIENAILTSENYDYFAKEFAHIFSISASKVVSATSAKSASEATSASWTAASRTGASSTTTATSESGITASSVATGAAAAISKTAAGSSSITYLARSFSRSLVSYLLQSAEFHSVFYSGISSGIASHIASTAGTSTAESLDLASLKSVIATACGKAMAATNSDGGPHAFANSLGSAITAVLIENAILTSENYDYFAKEFAHIFSISASKVVSATSAKSASEATSASWTAASRTGASSTTTATSESGITASSVATGAAAAISKTAAGSSSITYLARSFSRSLVSYLLQSAEFHSVFYSGISSGIASHIASTAGTSTAESLDLASLKSVIATACGKAMAATNSDGGPHAFANSLGSAITAVLIENAILTSENYDYFAKEFAHIFSISASKVVSATSAKSASEATSASWTAASRTGASSTTTATSESGITASSVATGAAAAISKTAAGSSSITYLARSFSRSLVSYLLQSAEFHSVFYSGISSGIASHIASTAGTSTAESLDLASLKSVIATACGKAMAATNSDGGPHAFANSLGSAITAVLIENAILTSENYDYFAKEFAHIFSISASKVVSATSAKSASEATSASWTAASRTGDYKDDDDKDYKDDDDKDYKDDDDK

SEQ ID NO: 1418 - protein, 710 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGGGYGRGQGAGAGVGAGAGAAAGAAAIARAGGYGQGAGGYGQGQGAGAAAGAAAGAGAGGYGQGAGGYGRGQGAGAGAGAGAGARGYGQGAGAGAAAGAAASAGAGGYGQGAGGYGQGQGAGAAAGAAASAGAGGYGQGAGGYGQGQGAGGGYGRGQGAGAGVGAGAGAAAGAAAIARAGGYGQGAGGYGQGQGAGAAAGAAAGAGAGGYGQGAGGYGRGQGAGAGAGAGAGARGYGQGAGAGAAAGAAASAGAGGYGQGAGGYGQGQGAGAAAGAAASAGAGGYGQGAGGYGQGQGAGGGYGRGQGAGAGVGAGAGAAAGAAAIARAGGYGQGAGGYGQGQGAGAAAGAAAGAGAGGYGQGAGGYGRGQGAGAGAGAGAGARGYGQGAGAGAAAGAAASAGAGGYGQGAGGYGQGQGAGAAAGAAASAGAGGYGQGAGGYGQGQGAGGGYGRGQGAGAGVGAGAGAAAGAAAIARAGGYGQGAGGYGQGQGAGAAAGAAAGAGAGGYGQGAGGYGRGQGAGAGAGAGAGARGYGQGAGAGAAAGAAASAGAGGYGQGAGGYGQGQGAGAAAGAAASAGAGGYGQGAGGYGQGQGAGDYKDDDDKDYKDDDDKDYKDDDDK

SEQ ID NO: 1419 - protein, 926 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGGGVGSLTGQTSFGQTSGFTSTAGAQGGFGPTTGAQSALISRIANALANTSTLRSVLRTGVSQQTASSVVQRAIQTLASNLGIDGNNLSRIALQAISQVPAGSDTSAYAQAFSTALVTGGVLNANNVDTLGSQVLSAVLNGVSSAAQGLGINVDTGSVQSDIRSSSSSLSTSSSSASFSQTSGAASTTGFTGAGGYPGGAGPLGGGVGSLTGQTSFGQTSGFTSTAGAQGGFGPTTGAQSALISRIANALANTSTLRSVLRTGVSQQTASSVVQRAIQTLASNLGIDGNNLSRIALQAISQVPAGSDTSAYAQAFSTALVTGGVLNANNVDTLGSQVLSAVLNGVSSAAQGLGINVDTGSVQSDIRSSSSSLSTSSSSASFSQTSGAASTTGFTGAGGYPGGAGPLGGGVGSLTGQTSFGQTSGFTSTAGAQGGFGPTTGAQSALISRIANALANTSTLRSVLRTGVSQQTASSVVQRAIQTLASNLGIDGNNLSRIALQAISQVPAGSDTSAYAQAFSTALVTGGVLNANNVDTLGSQVLSAVLNGVSSAAQGLGINVDTGSVQSDIRSSSSSLSTSSSSASFSQTSGAASTTGFTGAGGYPGGAGPLGGGVGSLTGQTSFGQTSGFTSTAGAQGGFGPTTGAQSALISRIANALANTSTLRSVLRTGVSQQTASSVVQRAIQTLASNLGIDGNNLSRIALQAISQVPAGSDTSAYAQAFSTALVTGGVLNANNVDTLGSQVLSAVLNGVSSAAQGLGINVDTGSVQSDIRSSSSSLSTSSSSASFSQTSGAASTTGFTGAGGYPGGAGPLGDYKDDDDKDYKDDDDKDYKDDDDK

SEQ ID NO: 1420 - protein, 834 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGSLASSFASALSASAASVASSAAAQSASQSQAAASAFSRAASQSASQSAARSGAQSSSTTTTTSASGSQAASQSASSAASQASASSFAQASSASLAASSSFSSAFSSANSLSALGNVAYQLGFNVANTLGIGNAPGLGAALSQAVSSVGVGASSSTYANVVSNAVGQFLAGQGVLNAANAGSLASSFASALSASAASVASSAAAQSASQSQAAASAFSRAASQSASQSAARSGAQSSSTTTTTSASGSQAASQSASSAASQASASSFAQASSASLAASSSFSSAFSSANSLSALGNVAYQLGFNVANTLGIGNAPGLGAALSQAVSSVGVGASSSTYANVVSNAVGQFLAGQGVLNAANAGSLASSFASALSASAASVASSAAAQSASQSQAAASAFSRAASQSASQSAARSGAQSSSTTTTTSASGSQAASQSASSAASQASASSFAQASSASLAASSSFSSAFSSANSLSALGNVAYQLGFNVANTLGIGNAPGLGAALSQAVSSVGVGASSSTYANVVSNAVGQFLAGQGVLNAANAGSLASSFASALSASAASVASSAAAQSASQSQAAASAFSRAASQSASQSAARSGAQSSSTTTTTSASGSQAASQSASSAASQASASSFAQASSASLAASSSFSSAFSSANSLSALGNVAYQLGFNVANTLGIGNAPGLGAALSQAVSSVGVGASSSTYANVVSNAVGQFLAGQGVLNAANAGDYKDDDDKDYKDDDDKDYKDDDDK

SEQ ID NO: 1421 - protein, 834 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGAASAAGASSAAAASASAAAASFTQNLIYSLQESEIFYSALRSIASSGEASNLAYLAAERAAYGAGLDGIASSVASAAASAFANTALGSGAAAYAKALAYAIAPVLTRANIITLSNAASLATTYAKGFASSAASAAASASAASAAAASSAASASSAAAAAAASSSTSTSTTVSRSTAAAAGAASAAGASSAAAASASAAAASFTQNLIYSLQESEIFYSALRSIASSGEASNLAYLAAERAAYGAGLDGIASSVASAAASAFANTALGSGAAAYAKALAYAIAPVLTRANIITLSNAASLATTYAKGFASSAASAAASASAASAAAASSAASASSAAAAAAASSSTSTSTTVSRSTAAAAGAASAAGASSAAAASASAAAASFTQNLIYSLQESEIFYSALRSIASSGEASNLAYLAAERAAYGAGLDGIASSVASAAASAFANTALGSGAAAYAKALAYAIAPVLTRANIITLSNAASLATTYAKGFASSAASAAASASAASAAAASSAASASSAAAAAAASSSTSTSTTVSRSTAAAAGAASAAGASSAAAASASAAAASFTQNLIYSLQESEIFYSALRSIASSGEASNLAYLAAERAAYGAGLDGIASSVASAAASAFANTALGSGAAAYAKALAYAIAPVLTRANIITLSNAASLATTYAKGFASSAASAAASASAASAAAASSAASASSAAAAAAASSSTSTSTTVSRSTAAAAGDYKDDDDKDYKDDDDKDYKDDDDK

SEQ ID NO: 1422 - protein, 770 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGAGAGGAGGYGAGQGYGAGAGAGAAAGAGAGGARGYGARQGYGSGAGAGAGARAGGAGGYGRGAGAGAAAASGAGAGGYGAGQGYGAGAGAVASAAAGAGSGAGGAGGYGRGAGAVAGAGAGGAGGYGAGAGAAAGVGAGGSGGYGGRQGGYSAGAGAGAAAAAGAGAGGAGGYGAGQGYGAGAGAGAAAGAGAGGARGYGARQGYGSGAGAGAGARAGGAGGYGRGAGAGAAAASGAGAGGYGAGQGYGAGAGAVASAAAGAGSGAGGAGGYGRGAGAVAGAGAGGAGGYGAGAGAAAGVGAGGSGGYGGRQGGYSAGAGAGAAAAAGAGAGGAGGYGAGQGYGAGAGAGAAAGAGAGGARGYGARQGYGSGAGAGAGARAGGAGGYGRGAGAGAAAASGAGAGGYGAGQGYGAGAGAVASAAAGAGSGAGGAGGYGRGAGAVAGAGAGGAGGYGAGAGAAAGVGAGGSGGYGGRQGGYSAGAGAGAAAAAGAGAGGAGGYGAGQGYGAGAGAGAAAGAGAGGARGYGARQGYGSGAGAGAGARAGGAGGYGRGAGAGAAAASGAGAGGYGAGQGYGAGAGAVASAAAGAGSGAGGAGGYGRGAGAVAGAGAGGAGGYGAGAGAAAGVGAGGSGGYGGRQGGYSAGAGAGAAAAAGDYKDDDDKDYKDDDDKDYKDDDDK

SEQ ID NO: 1423 - protein, 914 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGAGYTGPSGPSTGPSGYPGPLGGGAPFGQSGFGGSDGPQGGFGATGGASAGLISRVANALANTSTLRTVLRTGVSQQIASSVVQRAAQSLASTLGVDGNNLARFAVQAVSRLPAGSDTSAYAQAFSSALFNAGVLNASNIDTLGSRVLSALLNGVSSAAQGLGINVDSGSVQSDISSSSSFLSTSSSSASYSQASASSTSGAGYTGPSGPSTGPSGYPGPLGGGAPFGQSGFGGSDGPQGGFGATGGASAGLISRVANALANTSTLRTVLRTGVSQQIASSVVQRAAQSLASTLGVDGNNLARFAVQAVSRLPAGSDTSAYAQAFSSALFNAGVLNASNIDTLGSRVLSALLNGVSSAAQGLGINVDSGSVQSDISSSSSFLSTSSSSASYSQASASSTSGAGYTGPSGPSTGPSGYPGPLGGGAPFGQSGFGGSDGPQGGFGATGGASAGLISRVANALANTSTLRTVLRTGVSQQIASSVVQRAAQSLASTLGVDGNNLARFAVQAVSRLPAGSDTSAYAQAFSSALFNAGVLNASNIDTLGSRVLSALLNGVSSAAQGLGINVDSGSVQSDISSSSSFLSTSSSSASYSQASASSTSGAGYTGPSGPSTGPSGYPGPLGGGAPFGQSGFGGSDGPQGGFGATGGASAGLISRVANALANTSTLRTVLRTGVSQQIASSVVQRAAQSLASTLGVDGNNLARFAVQAVSRLPAGSDTSAYAQAFSSALFNAGVLNASNIDTLGSRVLSALLNGVSSAAQGLGINVDSGSVQSDISSSSSFLSTSSSSASYSQASASSTSGDYKDDDDKDYKDDDDKDYKDDDDK

SEQ ID NO: 1424 - protein, 1226 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGSQAGSQAGSQAGSQAGSQAASQAGSQSASQASASSSASAFASASAFAQSASFALSSSSSFASAVSSASSVSALGTLGYQVGLQAAGSLGISNSQAFASSISQALTSVGVGASSSAYASAVSGVVAQYLSGTGVLTSANAQALASSFANVFAASAASASAAASASSAASAQSAAAALAQSQSAASAFSQAASQAFSQAASQAGSQAASQAGSQAASQAGSQAASQAGSQAASQAGSQAASQSGSGASSFTTTISRSSAGSQTGSQAGSQAGSQAGSQAGSQAGSQAGSQAGSQAGSQAASQAGSQSASQASASSSASAFASASAFAQSASFALSSSSSFASAVSSASSVSALGTLGYQVGLQAAGSLGISNSQAFASSISQALTSVGVGASSSAYASAVSGVVAQYLSGTGVLTSANAQALASSFANVFAASAASASAAASASSAASAQSAAAALAQSQSAASAFSQAASQAFSQAASQAGSQAASQAGSQAASQAGSQAASQAGSQAASQAGSQAASQSGSGASSFTTTISRSSAGSQTGSQAGSQAGSQAGSQAGSQAGSQAGSQAGSQAGSQAASQAGSQSASQASASSSASAFASASAFAQSASFALSSSSSFASAVSSASSVSALGTLGYQVGLQAAGSLGISNSQAFASSISQALTSVGVGASSSAYASAVSGVVAQYLSGTGVLTSANAQALASSFANVFAASAASASAAASASSAASAQSAAAALAQSQSAASAFSQAASQAFSQAASQAGSQAASQAGSQAASQAGSQAASQAGSQAASQAGSQAASQSGSGASSFTTTISRSSAGSQTGSQAGSQAGSQAGSQAGSQAGSQAGSQAGSQAGSQAASQAGSQSASQASASSSASAFASASAFAQSASFALSSSSSFASAVSSASSVSALGTLGYQVGLQAAGSLGISNSQAFASSISQALTSVGVGASSSAYASAVSGVVAQYLSGTGVLTSANAQALASSFANVFAASAASASAAASASSAASAQSAAAALAQSQSAASAFSQAASQAFSQAASQAGSQAASQAGSQAASQAGSQAASQAGSQAASQAGSQAASQSGSGASSFTTTISRSSAGSQTGSQAGSQAGSQAGSQAGDYKDDDDKDYKDDDDKDYKDDDDK

SEQ ID NO: 1425 - protein, 790 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGAGAGAGAGAGAGYSAGAGYGIGAGAGVGAGAGAGAGAGSGTGTGAGYGYGSSTQSSSTIYAATYQGGYGRVAGLGAGAGAGAGAGGGAGAGAGTGAGAGAGIGAGYGAGAGYGAGAGTGSGAGAGAGGGAAAGAGSGVGAGYGAGAGYGAGAGAGGGAGAGAGSGASAGAGAGAGAGAGAGYSAGAGYGIGAGAGVGAGAGAGAGAGSGTGTGAGYGYGSSTQSSSTIYAATYQGGYGRVAGLGAGAGAGAGAGGGAGAGAGTGAGAGAGIGAGYGAGAGYGAGAGTGSGAGAGAGGGAAAGAGSGVGAGYGAGAGYGAGAGAGGGAGAGAGSGASAGAGAGAGAGAGAGYSAGAGYGIGAGAGVGAGAGAGAGAGSGTGTGAGYGYGSSTQSSSTIYAATYQGGYGRVAGLGAGAGAGAGAGGGAGAGAGTGAGAGAGIGAGYGAGAGYGAGAGTGSGAGAGAGGGAAAGAGSGVGAGYGAGAGYGAGAGAGGGAGAGAGSGASAGAGAGAGAGAGAGYSAGAGYGIGAGAGVGAGAGAGAGAGSGTGTGAGYGYGSSTQSSSTIYAATYQGGYGRVAGLGAGAGAGAGAGGGAGAGAGTGAGAGAGIGAGYGAGAGYGAGAGTGSGAGAGAGGGAAAGAGSGVGAGYGAGAGYGAGAGAGGGAGAGAGSGASAGDYKDDDDKDYKDDDDKDYKDDDDK

SEQ ID NO: 1426 - protein, 810 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGSGYGAGAGAGAGSGYGAGAGAGSGYGAGAGAGAGSGYVAGAGAGAGAGSGYGAGAGAGAGSSYSAGAGAGAGSGYGAGSSASAGSAVSTQTVSSSATTSSQSAAAATGAAYGTRASTGSGASAGAAASGAGAGYGGQAGYGQGGGAAAYRAGAGSQAAYGQGASGSSGAAAAAGSGYGAGAGAGAGSGYGAGAGAGSGYGAGAGAGAGSGYVAGAGAGAGAGSGYGAGAGAGAGSSYSAGAGAGAGSGYGAGSSASAGSAVSTQTVSSSATTSSQSAAAATGAAYGTRASTGSGASAGAAASGAGAGYGGQAGYGQGGGAAAYRAGAGSQAAYGQGASGSSGAAAAAGSGYGAGAGAGAGSGYGAGAGAGSGYGAGAGAGAGSGYVAGAGAGAGAGSGYGAGAGAGAGSSYSAGAGAGAGSGYGAGSSASAGSAVSTQTVSSSATTSSQSAAAATGAAYGTRASTGSGASAGAAASGAGAGYGGQAGYGQGGGAAAYRAGAGSQAAYGQGASGSSGAAAAAGSGYGAGAGAGAGSGYGAGAGAGSGYGAGAGAGAGSGYVAGAGAGAGAGSGYGAGAGAGAGSSYSAGAGAGAGSGYGAGSSASAGSAVSTQTVSSSATTSSQSAAAATGAAYGTRASTGSGASAGAAASGAGAGYGGQAGYGQGGGAAAYRAGAGSQAAYGQGASGSSGAAAAAGDYKDDDDKDYKDDDDKDYKDDDDK

SEQ ID NO: 1427 - protein, 726 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGAGAGGAGGYGRGAGAGAGAAAGAGAGAAAGAGAGGYGGQGGYGAGAGAGAAAAAGAGAGGAGGYGRGAGAGAGVAAGAGAGGYGGQGGYGAGAGAGAAAAAATGAGGAGGYGRGAGAGAGAAAGAGAGTGGAGYGGQGGYGAGAGAGAAAAAGAGAGGAGGYGRGAGAGAGAAAGAGAGAAAGAGAGGYGGQGGYGAGAGAGAAAAAGAGAGGAGGYGRGAGAGAGVAAGAGAGGYGGQGGYGAGAGAGAAAAAATGAGGAGGYGRGAGAGAGAAAGAGAGTGGAGYGGQGGYGAGAGAGAAAAAGAGAGGAGGYGRGAGAGAGAAAGAGAGAAAGAGAGGYGGQGGYGAGAGAGAAAAAGAGAGGAGGYGRGAGAGAGVAAGAGAGGYGGQGGYGAGAGAGAAAAAATGAGGAGGYGRGAGAGAGAAAGAGAGTGGAGYGGQGGYGAGAGAGAAAAAGAGAGGAGGYGRGAGAGAGAAAGAGAGAAAGAGAGGYGGQGGYGAGAGAGAAAAAGAGAGGAGGYGRGAGAGAGVAAGAGAGGYGGQGGYGAGAGAGAAAAAATGAGGAGGYGRGAGAGAGAAAGAGAGTGGAGYGGQGGYGAGAGAGAAAAAGDYKDDDDKDYKDDDDKDYKDDDDK

SEQ ID NO: 1428 - protein, 1070 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGAAQKQPSGESSVATASAAATSVTSGGAPVGKPGVPAPIFYPQGPLQQGPAPGPSNVQPGTSQQGPIGGVGGSNAFSSSFASALSLNRGFTEVISSASATAVASAFQKGLAPYGTAFALSAASAAADAYNSIGSGANAFAYAQAFARVLYPLVRQYGLSSSGKASAFASAIASSFSSGTSGQGPSIGQQQPPVTISAASASAGASAAAVGGGQVGQGPYGGQQQSTAASASAAAATATSGAAQKQPSGESSVATASAAATSVTSGGAPVGKPGVPAPIFYPQGPLQQGPAPGPSNVQPGTSQQGPIGGVGGSNAFSSSFASALSLNRGFTEVISSASATAVASAFQKGLAPYGTAFALSAASAAADAYNSIGSGANAFAYAQAFARVLYPLVRQYGLSSSGKASAFASAIASSFSSGTSGQGPSIGQQQPPVTISAASASAGASAAAVGGGQVGQGPYGGQQQSTAASASAAAATATSGAAQKQPSGESSVATASAAATSVTSGGAPVGKPGVPAPIFYPQGPLQQGPAPGPSNVQPGTSQQGPIGGVGGSNAFSSSFASALSLNRGFTEVISSASATAVASAFQKGLAPYGTAFALSAASAAADAYNSIGSGANAFAYAQAFARVLYPLVRQYGLSSSGKASAFASAIASSFSSGTSGQGPSIGQQQPPVTISAASASAGASAAAVGGGQVGQGPYGGQQQSTAASASAAAATATSGAAQKQPSGESSVATASAAATSVTSGGAPVGKPGVPAPIFYPQGPLQQGPAPGPSNVQPGTSQQGPIGGVGGSNAFSSSFASALSLNRGFTEVISSASATAVASAFQKGLAPYGTAFALSAASAAADAYNSIGSGANAFAYAQAFARVLYPLVRQYGLSSSGKASAFASAIASSFSSGTSGQGPSIGQQQPPVTISAASASAGASAAAVGGGQVGQGPYGGQQQSTAASASAAAATATSGDYKDDDDKDYKDDDDKDYKDDDDK

SEQ ID NO: 1429 - protein, 1186 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGGAPGGGPGGAGPGGAGFGPGGGAGFGPGGGAGFGPGGAAGGPGGPGGPGGPGGAGGYGPGGAGGYGPGGVGPGGAGGYGPGGAGGYGPGGSGPGGAGPGGAGGEGPVTVDVDVTVGPEGVGGGPGGAGPGGAGFGPGGGAGFGPGGAPGAPGGPGGPGGPGGPGGPGGVGPGGAGGYGPGGAGGVGPAGTGGFGPGGAGGFGPGGAGGFGPGGAGGFGPGGAGGYGPGGVGPGGAGGFGPGGVGPGGSGPGGAGGEGPVTVDVDVSVGGAPGGGPGGAGPGGAGFGPGGGAGFGPGGGAGFGPGGAAGGPGGPGGPGGPGGAGGYGPGGAGGYGPGGVGPGGAGGYGPGGAGGYGPGGSGPGGAGPGGAGGEGPVTVDVDVTVGPEGVGGGPGGAGPGGAGFGPGGGAGFGPGGAPGAPGGPGGPGGPGGPGGPGGVGPGGAGGYGPGGAGGVGPAGTGGFGPGGAGGFGPGGAGGFGPGGAGGFGPGGAGGYGPGGVGPGGAGGFGPGGVGPGGSGPGGAGGEGPVTVDVDVSVGGAPGGGPGGAGPGGAGFGPGGGAGFGPGGGAGFGPGGAAGGPGGPGGPGGPGGAGGYGPGGAGGYGPGGVGPGGAGGYGPGGAGGYGPGGSGPGGAGPGGAGGEGPVTVDVDVTVGPEGVGGGPGGAGPGGAGFGPGGGAGFGPGGAPGAPGGPGGPGGPGGPGGPGGVGPGGAGGYGPGGAGGVGPAGTGGFGPGGAGGFGPGGAGGFGPGGAGGFGPGGAGGYGPGGVGPGGAGGFGPGGVGPGGSGPGGAGGEGPVTVDVDVSVGGAPGGGPGGAGPGGAGFGPGGGAGFGPGGGAGFGPGGAAGGPGGPGGPGGPGGAGGYGPGGAGGYGPGGVGPGGAGGYGPGGAGGYGPGGSGPGGAGPGGAGGEGPVTVDVDVTVGPEGVGGGPGGAGPGGAGFGPGGGAGFGPGGAPGAPGGPGGPGGPGGPGGPGGVGPGGAGGYGPGGAGGVGPAGTGGFGPGGAGGFGPGGAGGFGPGGAGGFGPGGAGGYGPGGVGPGGAGGFGPGGVGPGGSGPGGAGGEGPVTVDVDVSVGDYKDDDDKDYKDDDDKDYKDDDDK

SEQ ID NO: 1430 - protein, 822 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGSGAARAAQTASAASAASASSSLQQSLGSALAQSSSFAAAFDQANSAASAAAIAYALAQSAANQVGLSSYSAAISNAAAAAVGSVGGYASASAYAFAFASGVSQVLSNYGLINLSNALFLASSIANAASASASSAAAAASSSSAATGAAAALGGAGSAAATSTTTITSTSTAVAAASGSGAARAAQTASAASAASASSSLQQSLGSALAQSSSFAAAFDQANSAASAAAIAYALAQSAANQVGLSSYSAAISNAAAAAVGSVGGYASASAYAFAFASGVSQVLSNYGLINLSNALFLASSIANAASASASSAAAAASSSSAATGAAAALGGAGSAAATSTTTITSTSTAVAAASGSGAARAAQTASAASAASASSSLQQSLGSALAQSSSFAAAFDQANSAASAAAIAYALAQSAANQVGLSSYSAAISNAAAAAVGSVGGYASASAYAFAFASGVSQVLSNYGLINLSNALFLASSIANAASASASSAAAAASSSSAATGAAAALGGAGSAAATSTTTITSTSTAVAAASGSGAARAAQTASAASAASASSSLQQSLGSALAQSSSFAAAFDQANSAASAAAIAYALAQSAANQVGLSSYSAAISNAAAAAVGSVGGYASASAYAFAFASGVSQVLSNYGLINLSNALFLASSIANAASASASSAAAAASSSSAATGAAAALGGAGSAAATSTTTITSTSTAVAAASGDYKDDDDKDYKDDDDKDYKDDDDK

SEQ ID NO: 1431 - protein, 1190 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGAGGSGPGGAGPGGAGPGGAGPGGVGPGGAGGPGGAGGPFGPGGSGPGGAGGAGGPYGPGGAYGPGGPGGPGGPGGPGSGGPYGPGGAYGPGGAYGPGGAYGPGGAGGPYGPGGPYGPGGPYGPGGAGGPGGAGGPYGPGGAGPGGYGPGGAGPGGYGPGGSGPGGAGPGGYGPGGSGPGGAGPGGYGPGGAGPGGYGPGGAGPGGAGPGGAGPGGYGPGGSGPGGPGSGGPGGAGGSGGTTVIEDLDITVNGPGGPITISEELTVGGPGAGGSGPGGAGPGGAGPGGAGPGGVGPGGAGGPGGAGGPFGPGGSGPGGAGGAGGPYGPGGAYGPGGPGGPGGPGGPGSGGPYGPGGAYGPGGAYGPGGAYGPGGAGGPYGPGGPYGPGGPYGPGGAGGPGGAGGPYGPGGAGPGGYGPGGAGPGGYGPGGSGPGGAGPGGYGPGGSGPGGAGPGGYGPGGAGPGGYGPGGAGPGGAGPGGAGPGGYGPGGSGPGGPGSGGPGGAGGSGGTTVIEDLDITVNGPGGPITISEELTVGGPGAGGSGPGGAGPGGAGPGGAGPGGVGPGGAGGPGGAGGPFGPGGSGPGGAGGAGGPYGPGGAYGPGGPGGPGGPGGPGSGGPYGPGGAYGPGGAYGPGGAYGPGGAGGPYGPGGPYGPGGPYGPGGAGGPGGAGGPYGPGGAGPGGYGPGGAGPGGYGPGGSGPGGAGPGGYGPGGSGPGGAGPGGYGPGGAGPGGYGPGGAGPGGAGPGGAGPGGYGPGGSGPGGPGSGGPGGAGGSGGTTVIEDLDITVNGPGGPITISEELTVGGPGAGGSGPGGAGPGGAGPGGAGPGGVGPGGAGGPGGAGGPFGPGGSGPGGAGGAGGPYGPGGAYGPGGPGGPGGPGGPGSGGPYGPGGAYGPGGAYGPGGAYGPGGAGGPYGPGGPYGPGGPYGPGGAGGPGGAGGPYGPGGAGPGGYGPGGAGPGGYGPGGSGPGGAGPGGYGPGGSGPGGAGPGGYGPGGAGPGGYGPGGAGPGGAGPGGAGPGGYGPGGSGPGGPGSGGPGGAGGSGGTTVIEDLDITVNGPGGPITISEELTVGGPGDYKDDDDKDYKDDDDKDYKDDDDK

SEQ ID NO: 1432 - protein, 818 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGSQAASQSASSSASQASASSFAQASSASLAASSSFSSAFSSATSLSALGNVAYQLGFDVGTNLGLTNAAGLAAAFSQAASSVGVGGSSGAYANALSNAAAQFLSAQGILNTVNAGSLASSFASALSSVAASAAAQASSQSQAASSAFSRAASQSASQSAARSGAQSSSSTTTTSSSGSQAASQSASSSASQASASSFAQASSASLAASSSFSSAFSSATSLSALGNVAYQLGFDVGTNLGLTNAAGLAAAFSQAASSVGVGGSSGAYANALSNAAAQFLSAQGILNTVNAGSLASSFASALSSVAASAAAQASSQSQAASSAFSRAASQSASQSAARSGAQSSSSTTTTSSSGSQAASQSASSSASQASASSFAQASSASLAASSSFSSAFSSATSLSALGNVAYQLGFDVGTNLGLTNAAGLAAAFSQAASSVGVGGSSGAYANALSNAAAQFLSAQGILNTVNAGSLASSFASALSSVAASAAAQASSQSQAASSAFSRAASQSASQSAARSGAQSSSSTTTTSSSGSQAASQSASSSASQASASSFAQASSASLAASSSFSSAFSSATSLSALGNVAYQLGFDVGTNLGLTNAAGLAAAFSQAASSVGVGGSSGAYANALSNAAAQFLSAQGILNTVNAGSLASSFASALSSVAASAAAQASSQSQAASSAFSRAASQSASQSAARSGAQSSSSTTTTSSSGDYKDDDDKDYKDDDDKDYKDDDDK

SEQ ID NO: 1433 - protein, 1046 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGGFGPGGAGPGGAGPGGAGPGGAGPGGAGPGGAGPGGAGPGGAGPGGAGGAGGAGGAGGSGGAGGSGGTTIIEDLDITIDGADGPITISEELTISGAGGSGPGGAGPGGVGPGGSGPGGVGPGGSGPGGVGPGGSGPGGVGPGGAGGPYGPGGSGPGGAGGAGGPGGAYGPGGSYGPGGSGGPGGAGGPYGPGGEGPGGAGGPYGPGGAGGPYGPGGAGGPYGPGGEGGPYGPGGFGPGGAGPGGAGPGGAGPGGAGPGGAGPGGAGPGGAGPGGAGPGGAGGAGGAGGAGGSGGAGGSGGTTIIEDLDITIDGADGPITISEELTISGAGGSGPGGAGPGGVGPGGSGPGGVGPGGSGPGGVGPGGSGPGGVGPGGAGGPYGPGGSGPGGAGGAGGPGGAYGPGGSYGPGGSGGPGGAGGPYGPGGEGPGGAGGPYGPGGAGGPYGPGGAGGPYGPGGEGGPYGPGGFGPGGAGPGGAGPGGAGPGGAGPGGAGPGGAGPGGAGPGGAGPGGAGGAGGAGGAGGSGGAGGSGGTTIIEDLDITIDGADGPITISEELTISGAGGSGPGGAGPGGVGPGGSGPGGVGPGGSGPGGVGPGGSGPGGVGPGGAGGPYGPGGSGPGGAGGAGGPGGAYGPGGSYGPGGSGGPGGAGGPYGPGGEGPGGAGGPYGPGGAGGPYGPGGAGGPYGPGGEGGPYGPGGFGPGGAGPGGAGPGGAGPGGAGPGGAGPGGAGPGGAGPGGAGPGGAGGAGGAGGAGGSGGAGGSGGTTIIEDLDITIDGADGPITISEELTISGAGGSGPGGAGPGGVGPGGSGPGGVGPGGSGPGGVGPGGSGPGGVGPGGAGGPYGPGGSGPGGAGGAGGPGGAYGPGGSYGPGGSGGPGGAGGPYGPGGEGPGGAGGPYGPGGAGGPYGPGGAGGPYGPGGEGGPYGPGDYKDDDDKDYKDDDDKDYKDDDDK

SEQ ID NO: 1434 - protein, 842 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGEAFSASSASSAVVFESAGPGEEAGSSGGGASAAASAAAAAGAGSGRRGPGGARSRGGAGAGAGAGSGVGGYGSGSGAGAGAGAGAGAGGEGGFGEGQGYGAGAGAGFGSGAGAGAGAGSGAGAGEGVGSGAGAGAGAGFGVGAGAGAGAGAGFGSGAGAGSGAGAGYGAGRAGGRGRGGRGGEAFSASSASSAVVFESAGPGEEAGSSGGGASAAASAAAAAGAGSGRRGPGGARSRGGAGAGAGAGSGVGGYGSGSGAGAGAGAGAGAGGEGGFGEGQGYGAGAGAGFGSGAGAGAGAGSGAGAGEGVGSGAGAGAGAGFGVGAGAGAGAGAGFGSGAGAGSGAGAGYGAGRAGGRGRGGRGGEAFSASSASSAVVFESAGPGEEAGSSGGGASAAASAAAAAGAGSGRRGPGGARSRGGAGAGAGAGSGVGGYGSGSGAGAGAGAGAGAGGEGGFGEGQGYGAGAGAGFGSGAGAGAGAGSGAGAGEGVGSGAGAGAGAGFGVGAGAGAGAGAGFGSGAGAGSGAGAGYGAGRAGGRGRGGRGGEAFSASSASSAVVFESAGPGEEAGSSGGGASAAASAAAAAGAGSGRRGPGGARSRGGAGAGAGAGSGVGGYGSGSGAGAGAGAGAGAGGEGGFGEGQGYGAGAGAGFGSGAGAGAGAGSGAGAGEGVGSGAGAGAGAGFGVGAGAGAGAGAGFGSGAGAGSGAGAGYGAGRAGGRGRGGRGGDYKDDDDKDYKDDDDKDYKDDDDK

SEQ ID NO: 1435 - protein, 1118 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGGYGPGAGQQGPGGAGQQGPGSQGPGGQGPYGPGAGQQGPGSQGPGSGGQQGPGGQGPYGPSAAAAAAAAGGYGPGAGQQGPGSQGPGSGGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGGAGQQGPGSQGPGGQGPYGPGAGQQGPGSQGPGSGGQQGPGGQGPYGPSAAAAAAAAGGYGPGAGQQGPGSQGPGSGGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGGAGQQGPGSQGPGGQGPYGPGAGQQGPGSQGPGSGGQQGPGGQGPYGPSAAAAAAAAGGYGPGAGQQGPGSQGPGSGGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGGAGQQGPGSQGPGGQGPYGPGAGQQGPGSQGPGSGGQQGPGGQGPYGPSAAAAAAAAGGYGPGAGQQGPGSQGPGSGGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGDYKDDDDKDYKDDDDKDYKDDDDK

SEQ ID NO: 1436 - protein, 834 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGNVGYQLGFNVANTLGIGNAPGLGNALSQAVSSVGVGASSSAYANAVSNAVGQFLAGQGVLNAGNAGSLASSFANALSASAASVASSAAAQSAFQSQAAASAFSRAASQSASQSAARSGAQSSSTTTTTSTSGSQAASQSASSAAAQASASSFAQASSASLAASSAFSSAFSSANSLSALGNVGYQLGFNVANTLGIGNAPGLGNALSQAVSSVGVGASSSAYANAVSNAVGQFLAGQGVLNAGNAGSLASSFANALSASAASVASSAAAQSAFQSQAAASAFSRAASQSASQSAARSGAQSSSTTTTTSTSGSQAASQSASSAAAQASASSFAQASSASLAASSAFSSAFSSANSLSALGNVGYQLGFNVANTLGIGNAPGLGNALSQAVSSVGVGASSSAYANAVSNAVGQFLAGQGVLNAGNAGSLASSFANALSASAASVASSAAAQSAFQSQAAASAFSRAASQSASQSAARSGAQSSSTTTTTSTSGSQAASQSASSAAAQASASSFAQASSASLAASSAFSSAFSSANSLSALGNVGYQLGFNVANTLGIGNAPGLGNALSQAVSSVGVGASSSAYANAVSNAVGQFLAGQGVLNAGNAGSLASSFANALSASAASVASSAAAQSAFQSQAAASAFSRAASQSASQSAARSGAQSSSTTTTTSTSGSQAASQSASSAAAQASASSFAQASSASLAASSAFSSAFSSANSLSALGDYKDDDDKDYKDDDDKDYKDDDDK

SEQ ID NO: 1437 - protein, 878 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGPGGAGGPYGPGGPGGAGPGGYGPGGYGPGGAGPGGAGPGGYGPGGAGPGGYGPGGAGPGGSGPGGIGPGGSGPGGYGPGGIGPGGTGPGGAGPGGAGPGGAGPSGAGPGGAGPSGAGRGGSGRGSVGRGGAGRGGAGRGGAGGAGGSGGAGGSGGAGGSGGTTIIEDLDITVDGANGPITISEELTIGGAGPGGAGGPYGPGGPGGAGPGGYGPGGYGPGGAGPGGAGPGGYGPGGAGPGGYGPGGAGPGGSGPGGIGPGGSGPGGYGPGGIGPGGTGPGGAGPGGAGPGGAGPSGAGPGGAGPSGAGRGGSGRGSVGRGGAGRGGAGRGGAGGAGGSGGAGGSGGAGGSGGTTIIEDLDITVDGANGPITISEELTIGGAGPGGAGGPYGPGGPGGAGPGGYGPGGYGPGGAGPGGAGPGGYGPGGAGPGGYGPGGAGPGGSGPGGIGPGGSGPGGYGPGGIGPGGTGPGGAGPGGAGPGGAGPSGAGPGGAGPSGAGRGGSGRGSVGRGGAGRGGAGRGGAGGAGGSGGAGGSGGAGGSGGTTIIEDLDITVDGANGPITISEELTIGGAGPGGAGGPYGPGGPGGAGPGGYGPGGYGPGGAGPGGAGPGGYGPGGAGPGGYGPGGAGPGGSGPGGIGPGGSGPGGYGPGGIGPGGTGPGGAGPGGAGPGGAGPSGAGPGGAGPSGAGRGGSGRGSVGRGGAGRGGAGRGGAGGAGGSGGAGGSGGAGGSGGTTIIEDLDITVDGANGPITISEELTIGGAGDYKDDDDKDYKDDDDKDYKDDDDK

SEQ ID NO: 1438 - protein, 1078 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGAGAGQGGRGGYGQGGFGGQGSGAGAGASAAAGAGAGQGGRGGYGQGGFGGQGSGAGAGASAAAGAGAGQGGRGGYGQGGFGGQGSGAGAGASAAAAAGAGQGGRGGYGQGGLGGSGSGAGAGAGAAAAAAAGAGGYGQGGLGGYGQGAGAGQGGLGGYGSGAGAGASAAAAAGAGGAGQGGLGGYGQGAGAGQGGLGGYGSGAGAGAAAAAAAGAGGSGQGGLGGYGSGGGAGGASAAAAGAGAGQGGRGGYGQGGFGGQGSGAGAGASAAAGAGAGQGGRGGYGQGGFGGQGSGAGAGASAAAGAGAGQGGRGGYGQGGFGGQGSGAGAGASAAAAAGAGQGGRGGYGQGGLGGSGSGAGAGAGAAAAAAAGAGGYGQGGLGGYGQGAGAGQGGLGGYGSGAGAGASAAAAAGAGGAGQGGLGGYGQGAGAGQGGLGGYGSGAGAGAAAAAAAGAGGSGQGGLGGYGSGGGAGGASAAAAGAGAGQGGRGGYGQGGFGGQGSGAGAGASAAAGAGAGQGGRGGYGQGGFGGQGSGAGAGASAAAGAGAGQGGRGGYGQGGFGGQGSGAGAGASAAAAAGAGQGGRGGYGQGGLGGSGSGAGAGAGAAAAAAAGAGGYGQGGLGGYGQGAGAGQGGLGGYGSGAGAGASAAAAAGAGGAGQGGLGGYGQGAGAGQGGLGGYGSGAGAGAAAAAAAGAGGSGQGGLGGYGSGGGAGGASAAAAGAGAGQGGRGGYGQGGFGGQGSGAGAGASAAAGAGAGQGGRGGYGQGGFGGQGSGAGAGASAAAGAGAGQGGRGGYGQGGFGGQGSGAGAGASAAAAAGAGQGGRGGYGQGGLGGSGSGAGAGAGAAAAAAAGAGGYGQGGLGGYGQGAGAGQGGLGGYGSGAGAGASAAAAAGAGGAGQGGLGGYGQGAGAGQGGLGGYGSGAGAGAAAAAAAGAGGSGQGGLGGYGSGGGAGGASAAAAGDYKDDDDKDYKDDDDKDYKDDDDK

SEQ ID NO: 1439 - protein, 1090 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGPGGYGGPGQPGPGQGQYGPGPGQQGPRQGGQQGPASAAAAAAAGPGGYGGPGQQGPRQGQQQGPASAAAAAAAAAAGPRGYGGPGQQGPVQGGQQGPASAAAAAAAAGVGGYGGPGQQGPGQGQYGPGTGQQGQGPSGQQGPAGAAAAAAGGAAGPGGYGGPGQQGPGQGQYGPGTGQQGQGPSGQQGPAGAAAAAAAAAGPGGYGGPGQQGPGQGQYGPGAGQQGQGPGSQQGPASAAAAAAGPGGYGGPGQPGPGQGQYGPGPGQQGPRQGGQQGPASAAAAAAAGPGGYGGPGQQGPRQGQQQGPASAAAAAAAAAAGPRGYGGPGQQGPVQGGQQGPASAAAAAAAAGVGGYGGPGQQGPGQGQYGPGTGQQGQGPSGQQGPAGAAAAAAGGAAGPGGYGGPGQQGPGQGQYGPGTGQQGQGPSGQQGPAGAAAAAAAAAGPGGYGGPGQQGPGQGQYGPGAGQQGQGPGSQQGPASAAAAAAGPGGYGGPGQPGPGQGQYGPGPGQQGPRQGGQQGPASAAAAAAAGPGGYGGPGQQGPRQGQQQGPASAAAAAAAAAAGPRGYGGPGQQGPVQGGQQGPASAAAAAAAAGVGGYGGPGQQGPGQGQYGPGTGQQGQGPSGQQGPAGAAAAAAGGAAGPGGYGGPGQQGPGQGQYGPGTGQQGQGPSGQQGPAGAAAAAAAAAGPGGYGGPGQQGPGQGQYGPGAGQQGQGPGSQQGPASAAAAAAGPGGYGGPGQPGPGQGQYGPGPGQQGPRQGGQQGPASAAAAAAAGPGGYGGPGQQGPRQGQQQGPASAAAAAAAAAAGPRGYGGPGQQGPVQGGQQGPASAAAAAAAAGVGGYGGPGQQGPGQGQYGPGTGQQGQGPSGQQGPAGAAAAAAGGAAGPGGYGGPGQQGPGQGQYGPGTGQQGQGPSGQQGPAGAAAAAAAAAGPGGYGGPGQQGPGQGQYGPGAGQQGQGPGSQQGPASAAAAAAGDYKDDDDKDYKDDDDKDYKDDDDK

SEQ ID NO: 1440 - DNA, 2400 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtgttttgaatgctggtaacgcttcggctcttgctggttcttttgcaagagccttgtctgcaagcgctgaatcacagagttttgctcaatcacaagcttatcagcaggccagtgcttttcagcaagctgctgctcagtccgcagcacagtcagcttctagagctggcagcacctcaagttctacgacaacaactacttcgggagctacatctcaagcagcttctcaaagcgcatcttctagttattcgagtgcctttgcacaagccgcttcttcctccctcgcaacctcttccgccatttccagagcatttgcctcagttagttcagcctctgccgcaagtagtctagcttacaacataggactatcagctgctcgcagtttgggaattgcatccgataccgccctggctggtgcattggcccaggccgtaggaggtgttggtgcaggtgcttcagcgtcagcgtatgcaaacgctatagctagagccgctggacaattcttggcaacacaaggtgttttgaatgctggtaacgcttcggctcttgctggttcttttgcaagagccttgtctgcaagcgctgaatcacagagttttgctcaatcacaagcttatcagcaggccagtgcttttcagcaagctgctgctcagtccgcagcacagtcagcttctagagctggcagcacctcaagttctacgacaacaactacttcgggagctacatctcaagcagcttctcaaagcgcatcttctagttattcgagtgcctttgcacaagccgcttcttcctccctcgcaacctcttccgccatttccagagcatttgcctcagttagttcagcctctgccgcaagtagtctagcttacaacataggactatcagctgctcgcagtttgggaattgcatccgataccgccctggctggtgcattggcccaggccgtaggaggtgttggtgcaggtgcttcagcgtcagcgtatgcaaacgctatagctagagccgctggacaattcttggcaacacaaggtgttttgaatgctggtaacgcttcggctcttgctggttcttttgcaagagccttgtctgcaagcgctgaatcacagagttttgctcaatcacaagcttatcagcaggccagtgcttttcagcaagctgctgctcagtccgcagcacagtcagcttctagagctggcagcacctcaagttctacgacaacaactacttcgggagctacatctcaagcagcttctcaaagcgcatcttctagttattcgagtgcctttgcacaagccgcttcttcctccctcgcaacctcttccgccatttccagagcatttgcctcagttagttcagcctctgccgcaagtagtctagcttacaacataggactatcagctgctcgcagtttgggaattgcatccgataccgccctggctggtgcattggcccaggccgtaggaggtgttggtgcaggtgcttcagcgtcagcgtatgcaaacgctatagctagagccgctggacaattcttggcaacacaaggtgttttgaatgctggtaacgcttcggctcttgctggttcttttgcaagagccttgtctgcaagcgctgaatcacagagttttgctcaatcacaagcttatcagcaggccagtgcttttcagcaagctgctgctcagtccgcagcacagtcagcttctagagctggcagcacctcaagttctacgacaacaactacttcgggagctacatctcaagcagcttctcaaagcgcatcttctagttattcgagtgcctttgcacaagccgcttcttcctccctcgcaacctcttccgccatttccagagcatttgcctcagttagttcagcctctgccgcaagtagtctagcttacaacataggactatcagctgctcgcagtttgggaattgcatccgataccgccctggctggtgcattggcccaggccgtaggaggtgttggtgcaggtgcttcagcgtcagcgtatgcaaacgctatagctagagccgctggacaattcttggcaacacaaggtgactacaaagatgacgacgataaagattacaaagacgatgacgataaggactataaagatgatgacgacaaataataa

SEQ ID NO: 1441 - DNA, 2844 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtatcaatgtcgattccgacataggttctgtaacctcgctcatactgtcaggtagcactctacaaatgactataccagccggtggtgatgatcttagcggaggttaccctggaggattcccagctggagcacaaccgagtggtggcgctcctgttgatttcggcggaccatcagctggcggtgacgttgctgcaaagctggctagatctttggcatctacattggcctcatcaggtgttttcagagcagcgtttaattccagagtatcaacacctgttgctgttcagtttacagatgccctagtgcagaaaatcgcctccaatcttggactggattacgctacggctagtaagctgcgaaaggcatcccaggctgtctccaaggtcagaatgggaagtgacactaacgcctacgccctggctatttcttcagctttagctgaagtattgtcctcatccggaaaagtcgcagacgctaatattaatcagattgctcctcagctagcctcaggtatcgttttaggagtttctactacggccccacagtttggagtagacttgagctcaattaatgttaatctcgacatttccaatgttgctcgcaatatgcaagccagcatacaaggtatcaatgtcgattccgacataggttctgtaacctcgctcatactgtcaggtagcactctacaaatgactataccagccggtggtgatgatcttagcggaggttaccctggaggattcccagctggagcacaaccgagtggtggcgctcctgttgatttcggcggaccatcagctggcggtgacgttgctgcaaagctggctagatctttggcatctacattggcctcatcaggtgttttcagagcagcgtttaattccagagtatcaacacctgttgctgttcagtttacagatgccctagtgcagaaaatcgcctccaatcttggactggattacgctacggctagtaagctgcgaaaggcatcccaggctgtctccaaggtcagaatgggaagtgacactaacgcctacgccctggctatttcttcagctttagctgaagtattgtcctcatccggaaaagtcgcagacgctaatattaatcagattgctcctcagctagcctcaggtatcgttttaggagtttctactacggccccacagtttggagtagacttgagctcaattaatgttaatctcgacatttccaatgttgctcgcaatatgcaagccagcatacaaggtatcaatgtcgattccgacataggttctgtaacctcgctcatactgtcaggtagcactctacaaatgactataccagccggtggtgatgatcttagcggaggttaccctggaggattcccagctggagcacaaccgagtggtggcgctcctgttgatttcggcggaccatcagctggcggtgacgttgctgcaaagctggctagatctttggcatctacattggcctcatcaggtgttttcagagcagcgtttaattccagagtatcaacacctgttgctgttcagtttacagatgccctagtgcagaaaatcgcctccaatcttggactggattacgctacggctagtaagctgcgaaaggcatcccaggctgtctccaaggtcagaatgggaagtgacactaacgcctacgccctggctatttcttcagctttagctgaagtattgtcctcatccggaaaagtcgcagacgctaatattaatcagattgctcctcagctagcctcaggtatcgttttaggagtttctactacggccccacagtttggagtagacttgagctcaattaatgttaatctcgacatttccaatgttgctcgcaatatgcaagccagcatacaaggtatcaatgtcgattccgacataggttctgtaacctcgctcatactgtcaggtagcactctacaaatgactataccagccggtggtgatgatcttagcggaggttaccctggaggattcccagctggagcacaaccgagtggtggcgctcctgttgatttcggcggaccatcagctggcggtgacgttgctgcaaagctggctagatctttggcatctacattggcctcatcaggtgttttcagagcagcgtttaattccagagtatcaacacctgttgctgttcagtttacagatgccctagtgcagaaaatcgcctccaatcttggactggattacgctacggctagtaagctgcgaaaggcatcccaggctgtctccaaggtcagaatgggaagtgacactaacgcctacgccctggctatttcttcagctttagctgaagtattgtcctcatccggaaaagtcgcagacgctaatattaatcagattgctcctcagctagcctcaggtatcgttttaggagtttctactacggccccacagtttggagtagacttgagctcaattaatgttaatctcgacatttccaatgttgctcgcaatatgcaagccagcatacaaggtgactacaaagatgacgacgataaagattacaaagacgatgacgataaggactataaagatgatgacgacaaataataa

SEQ ID NO: 1442 - DNA, 2376 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtgccgctgctacatcttcatcgaccagcggagcctcggcctctagtatttcgtccacaactgcctcaagttcttctacaggagcaagttcagctgccgctggagctagtcacggagcagcttcggcgggtggagcatttgattttacgagagctctattttctgaactgctagaatctaagatattttccgccaccacggcaaactttcatagttccacaacggcttctgaaactctttacgccaccattctgaagtgccttagggaattacacttcaggtacgacgaatgcttgcaaggtgcaactgaagtggtgagtgatttgtctgtagtatccgttggttctggagttcacaactacgctagagttattgcagctttctttgaacgcttctttcgaaagcacgacatcccattgtccgcaaactatgcttccagagttgcacagtatttaatttcagctatgggcagttcggtagcttccgcagacgcttcgtcgtcatcaggtgccgctgctacatcttcatcgaccagcggagcctcggcctctagtatttcgtccacaactgcctcaagttcttctacaggagcaagttcagctgccgctggagctagtcacggagcagcttcggcgggtggagcatttgattttacgagagctctattttctgaactgctagaatctaagatattttccgccaccacggcaaactttcatagttccacaacggcttctgaaactctttacgccaccattctgaagtgccttagggaattacacttcaggtacgacgaatgcttgcaaggtgcaactgaagtggtgagtgatttgtctgtagtatccgttggttctggagttcacaactacgctagagttattgcagctttctttgaacgcttctttcgaaagcacgacatcccattgtccgcaaactatgcttccagagttgcacagtatttaatttcagctatgggcagttcggtagcttccgcagacgcttcgtcgtcatcaggtgccgctgctacatcttcatcgaccagcggagcctcggcctctagtatttcgtccacaactgcctcaagttcttctacaggagcaagttcagctgccgctggagctagtcacggagcagcttcggcgggtggagcatttgattttacgagagctctattttctgaactgctagaatctaagatattttccgccaccacggcaaactttcatagttccacaacggcttctgaaactctttacgccaccattctgaagtgccttagggaattacacttcaggtacgacgaatgcttgcaaggtgcaactgaagtggtgagtgatttgtctgtagtatccgttggttctggagttcacaactacgctagagttattgcagctttctttgaacgcttctttcgaaagcacgacatcccattgtccgcaaactatgcttccagagttgcacagtatttaatttcagctatgggcagttcggtagcttccgcagacgcttcgtcgtcatcaggtgccgctgctacatcttcatcgaccagcggagcctcggcctctagtatttcgtccacaactgcctcaagttcttctacaggagcaagttcagctgccgctggagctagtcacggagcagcttcggcgggtggagcatttgattttacgagagctctattttctgaactgctagaatctaagatattttccgccaccacggcaaactttcatagttccacaacggcttctgaaactctttacgccaccattctgaagtgccttagggaattacacttcaggtacgacgaatgcttgcaaggtgcaactgaagtggtgagtgatttgtctgtagtatccgttggttctggagttcacaactacgctagagttattgcagctttctttgaacgcttctttcgaaagcacgacatcccattgtccgcaaactatgcttccagagttgcacagtatttaatttcagctatgggcagttcggtagcttccgcagacgcttcgtcgtcatcaggtgactacaaagatgacgacgataaagattacaaagacgatgacgataaggactataaagatgatgacgacaaataataa

SEQ ID NO: 1443 - DNA, 2940 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtgccggagctggtggcgctggtggttatgcacaaggttacggagctggtgcaggagcaggtgctggtgccggaacaggtgcaggtggtgctggtggttacggtcaaggttacggagcaggatccggcgcgggtgcaggaggagctggtggatatggtgctggtgctggagccggtgctggagccggagatgcctccggatacggtcaaggatatggagatggagcaggagctggtgctggagctgctgctgcagcaggtgccgctgctggtgctagaggagccggaggctacggaggtggtgctggagctggagcgggtgccggtgccggagctgccggaggttatggacagggttacggtgcaggtgccggagaaggagcaggtgccggcgccggtgccggtgccgttgccggtgcaggagctgctgctgctgctggagcaggtgccggtgctggaggtgccgaaggttacggtgctggcgctggtgctggcggtgccggtggttacggtcagagctacggagatggagccgcagctgcagccggctctggcgctggtgcaggtggatcaggcggatacggtgctggtgcaggcgccggatctggtgctggagcagctggcggttatggtggtggagccggtgcaggtgccggagctggtggcgctggtggttatgcacaaggttacggagctggtgcaggagcaggtgctggtgccggaacaggtgcaggtggtgctggtggttacggtcaaggttacggagcaggatccggcgcgggtgcaggaggagctggtggatatggtgctggtgctggagccggtgctggagccggagatgcctccggatacggtcaaggatatggagatggagcaggagctggtgctggagctgctgctgcagcaggtgccgctgctggtgctagaggagccggaggctacggaggtggtgctggagctggagcgggtgccggtgccggagctgccggaggttatggacagggttacggtgcaggtgccggagaaggagcaggtgccggcgccggtgccggtgccgttgccggtgcaggagctgctgctgctgctggagcaggtgccggtgctggaggtgccgaaggttacggtgctggcgctggtgctggcggtgccggtggttacggtcagagctacggagatggagccgcagctgcagccggctctggcgctggtgcaggtggatcaggcggatacggtgctggtgcaggcgccggatctggtgctggagcagctggcggttatggtggtggagccggtgcaggtgccggagctggtggcgctggtggttatgcacaaggttacggagctggtgcaggagcaggtgctggtgccggaacaggtgcaggtggtgctggtggttacggtcaaggttacggagcaggatccggcgcgggtgcaggaggagctggtggatatggtgctggtgctggagccggtgctggagccggagatgcctccggatacggtcaaggatatggagatggagcaggagctggtgctggagctgctgctgcagcaggtgccgctgctggtgctagaggagccggaggctacggaggtggtgctggagctggagcgggtgccggtgccggagctgccggaggttatggacagggttacggtgcaggtgccggagaaggagcaggtgccggcgccggtgccggtgccgttgccggtgcaggagctgctgctgctgctggagcaggtgccggtgctggaggtgccgaaggttacggtgctggcgctggtgctggcggtgccggtggttacggtcagagctacggagatggagccgcagctgcagccggctctggcgctggtgcaggtggatcaggcggatacggtgctggtgcaggcgccggatctggtgctggagcagctggcggttatggtggtggagccggtgcaggtgccggagctggtggcgctggtggttatgcacaaggttacggagctggtgcaggagcaggtgctggtgccggaacaggtgcaggtggtgctggtggttacggtcaaggttacggagcaggatccggcgcgggtgcaggaggagctggtggatatggtgctggtgctggagccggtgctggagccggagatgcctccggatacggtcaaggatatggagatggagcaggagctggtgctggagctgctgctgcagcaggtgccgctgctggtgctagaggagccggaggctacggaggtggtgctggagctggagcgggtgccggtgccggagctgccggaggttatggacagggttacggtgcaggtgccggagaaggagcaggtgccggcgccggtgccggtgccgttgccggtgcaggagctgctgctgctgctggagcaggtgccggtgctggaggtgccgaaggttacggtgctggcgctggtgctggcggtgccggtggttacggtcagagctacggagatggagccgcagctgcagccggctctggcgctggtgcaggtggatcaggcggatacggtgctggtgcaggcgccggatctggtgctggagcagctggcggttatggtggtggagccggtgcaggtgactacaaagatgacgacgataaagattacaaagacgatgacgataaggactataaagatgatgacgacaaataataa

SEQ ID NO: 1444 - DNA, 2928 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggttcttccgccggacttgtaagcagagtcgcaaatgcattggctaacaccagtacattacgcgctgttctgcgaaggggtgtaagtcaacagactgcttcctccgtcgtgcagagagccgttcaatcccttgccggaacgctaggagttgatggaaattccttgtccagaattgccctgcaagcaattagtcaattgcctggtggtagtgatacttctgcatacgcccaggctttctcatctgctttattcaacgcaggtgtattgaacgcttcaaacatagacactttgggttcgagggttttgtctgccgttctgaacggtgtctcttctgccgcccaaggtattggactcaacgttgatacaggttctgtacaaagcgacatttcttctagttcatcttttttatcaagtagtagttcgtcggcaagtttcagccaaacctccgcttcgagcacctctggtgccggttatacagccccagctggaccgtctggatacactggtccttccggaccatccggatacacgggtccggtaggaggtgctgctcaatttggatctgtttcaggtcaaacatctttcggacaaacatcaggatttactgcaagtaccggcggacaggctgctttcggtgcaacctcaggttcttccgccggacttgtaagcagagtcgcaaatgcattggctaacaccagtacattacgcgctgttctgcgaaggggtgtaagtcaacagactgcttcctccgtcgtgcagagagccgttcaatcccttgccggaacgctaggagttgatggaaattccttgtccagaattgccctgcaagcaattagtcaattgcctggtggtagtgatacttctgcatacgcccaggctttctcatctgctttattcaacgcaggtgtattgaacgcttcaaacatagacactttgggttcgagggttttgtctgccgttctgaacggtgtctcttctgccgcccaaggtattggactcaacgttgatacaggttctgtacaaagcgacatttcttctagttcatcttttttatcaagtagtagttcgtcggcaagtttcagccaaacctccgcttcgagcacctctggtgccggttatacagccccagctggaccgtctggatacactggtccttccggaccatccggatacacgggtccggtaggaggtgctgctcaatttggatctgtttcaggtcaaacatctttcggacaaacatcaggatttactgcaagtaccggcggacaggctgctttcggtgcaacctcaggttcttccgccggacttgtaagcagagtcgcaaatgcattggctaacaccagtacattacgcgctgttctgcgaaggggtgtaagtcaacagactgcttcctccgtcgtgcagagagccgttcaatcccttgccggaacgctaggagttgatggaaattccttgtccagaattgccctgcaagcaattagtcaattgcctggtggtagtgatacttctgcatacgcccaggctttctcatctgctttattcaacgcaggtgtattgaacgcttcaaacatagacactttgggttcgagggttttgtctgccgttctgaacggtgtctcttctgccgcccaaggtattggactcaacgttgatacaggttctgtacaaagcgacatttcttctagttcatcttttttatcaagtagtagttcgtcggcaagtttcagccaaacctccgcttcgagcacctctggtgccggttatacagccccagctggaccgtctggatacactggtccttccggaccatccggatacacgggtccggtaggaggtgctgctcaatttggatctgtttcaggtcaaacatctttcggacaaacatcaggatttactgcaagtaccggcggacaggctgctttcggtgcaacctcaggttcttccgccggacttgtaagcagagtcgcaaatgcattggctaacaccagtacattacgcgctgttctgcgaaggggtgtaagtcaacagactgcttcctccgtcgtgcagagagccgttcaatcccttgccggaacgctaggagttgatggaaattccttgtccagaattgccctgcaagcaattagtcaattgcctggtggtagtgatacttctgcatacgcccaggctttctcatctgctttattcaacgcaggtgtattgaacgcttcaaacatagacactttgggttcgagggttttgtctgccgttctgaacggtgtctcttctgccgcccaaggtattggactcaacgttgatacaggttctgtacaaagcgacatttcttctagttcatcttttttatcaagtagtagttcgtcggcaagtttcagccaaacctccgcttcgagcacctctggtgccggttatacagccccagctggaccgtctggatacactggtccttccggaccatccggatacacgggtccggtaggaggtgctgctcaatttggatctgtttcaggtcaaacatctttcggacaaacatcaggatttactgcaagtaccggcggacaggctgctttcggtgcaacctcaggtgactacaaagatgacgacgataaagattacaaagacgatgacgataaggactataaagatgatgacgacaaataataa

SEQ ID NO: 1445 - DNA, 2508 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtagtctggctagctcctttgctagtgctttatctgcgtcggccgcatcagtggcctcatccgcagcagcacaggctgcttctcaaagtcaggccgcggcatccgcattttcacgtgctgcgtctcaatctgcatcacagtccgcagcaaggtcgggagcacaaagtagttcaacaactaccacaacttctaccgctggttcgcaggccgcatcccaattcgcatcttcagctgctagccaagcctctgctagttcattcgcgagggcatcatcggcctcactggctgcatcatcttcgttctcttctgcattttcttccgcaaattcactgtcggctctgggtaacgtcggttaccaattgggcttcaatgtagctaataacttgggaatctcaaatgccgcaggattgggtaacgctttatcacaggccgtttcttccgtcggagtaggcgctagttcttcctcttatgccaacgcagtttccaatgcagtgggtcagtttttggctggacaaggtatcttaaacgcagctaacgcaggtagtctggctagctcctttgctagtgctttatctgcgtcggccgcatcagtggcctcatccgcagcagcacaggctgcttctcaaagtcaggccgcggcatccgcattttcacgtgctgcgtctcaatctgcatcacagtccgcagcaaggtcgggagcacaaagtagttcaacaactaccacaacttctaccgctggttcgcaggccgcatcccaattcgcatcttcagctgctagccaagcctctgctagttcattcgcgagggcatcatcggcctcactggctgcatcatcttcgttctcttctgcattttcttccgcaaattcactgtcggctctgggtaacgtcggttaccaattgggcttcaatgtagctaataacttgggaatctcaaatgccgcaggattgggtaacgctttatcacaggccgtttcttccgtcggagtaggcgctagttcttcctcttatgccaacgcagtttccaatgcagtgggtcagtttttggctggacaaggtatcttaaacgcagctaacgcaggtagtctggctagctcctttgctagtgctttatctgcgtcggccgcatcagtggcctcatccgcagcagcacaggctgcttctcaaagtcaggccgcggcatccgcattttcacgtgctgcgtctcaatctgcatcacagtccgcagcaaggtcgggagcacaaagtagttcaacaactaccacaacttctaccgctggttcgcaggccgcatcccaattcgcatcttcagctgctagccaagcctctgctagttcattcgcgagggcatcatcggcctcactggctgcatcatcttcgttctcttctgcattttcttccgcaaattcactgtcggctctgggtaacgtcggttaccaattgggcttcaatgtagctaataacttgggaatctcaaatgccgcaggattgggtaacgctttatcacaggccgtttcttccgtcggagtaggcgctagttcttcctcttatgccaacgcagtttccaatgcagtgggtcagtttttggctggacaaggtatcttaaacgcagctaacgcaggtagtctggctagctcctttgctagtgctttatctgcgtcggccgcatcagtggcctcatccgcagcagcacaggctgcttctcaaagtcaggccgcggcatccgcattttcacgtgctgcgtctcaatctgcatcacagtccgcagcaaggtcgggagcacaaagtagttcaacaactaccacaacttctaccgctggttcgcaggccgcatcccaattcgcatcttcagctgctagccaagcctctgctagttcattcgcgagggcatcatcggcctcactggctgcatcatcttcgttctcttctgcattttcttccgcaaattcactgtcggctctgggtaacgtcggttaccaattgggcttcaatgtagctaataacttgggaatctcaaatgccgcaggattgggtaacgctttatcacaggccgtttcttccgtcggagtaggcgctagttcttcctcttatgccaacgcagtttccaatgcagtgggtcagtttttggctggacaaggtatcttaaacgcagctaacgcaggtgactacaaagatgacgacgataaagattacaaagacgatgacgataaggactataaagatgatgacgacaaataataa

SEQ ID NO: 1446 - DNA, 2496 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtgctagctccaccactaccgctacctctgaatccggaattacagcttcatcggttgccacaggagctgctgcagccataagtaaaactgcagcaggatcttctagcatcacctatttggccagatcatttagtaggtcattggtgagttatttgttacaaagtgccgaattccactccgttttctactctggaattagttcaggtattgccagtcatattgcttcgacagcaggtacgtctacggctgaatctttggacctggcttccctgaagtccgtgatagcaactgcctgtggtaaagctatggcggctactaactctgatggtggaccacacgcctttgccaattccctgggttccgccattacggccgttttgattgaaaacgctattcttacgtcagagaattatgattattttgctaaagaattcgcacacatattctccatttctgcatctaaggtagtaagtgccacctccgcaaaatctgcaagtgaagccaccagtgcttcgtggacagctgcgtcacgtacaggtgctagctccaccactaccgctacctctgaatccggaattacagcttcatcggttgccacaggagctgctgcagccataagtaaaactgcagcaggatcttctagcatcacctatttggccagatcatttagtaggtcattggtgagttatttgttacaaagtgccgaattccactccgttttctactctggaattagttcaggtattgccagtcatattgcttcgacagcaggtacgtctacggctgaatctttggacctggcttccctgaagtccgtgatagcaactgcctgtggtaaagctatggcggctactaactctgatggtggaccacacgcctttgccaattccctgggttccgccattacggccgttttgattgaaaacgctattcttacgtcagagaattatgattattttgctaaagaattcgcacacatattctccatttctgcatctaaggtagtaagtgccacctccgcaaaatctgcaagtgaagccaccagtgcttcgtggacagctgcgtcacgtacaggtgctagctccaccactaccgctacctctgaatccggaattacagcttcatcggttgccacaggagctgctgcagccataagtaaaactgcagcaggatcttctagcatcacctatttggccagatcatttagtaggtcattggtgagttatttgttacaaagtgccgaattccactccgttttctactctggaattagttcaggtattgccagtcatattgcttcgacagcaggtacgtctacggctgaatctttggacctggcttccctgaagtccgtgatagcaactgcctgtggtaaagctatggcggctactaactctgatggtggaccacacgcctttgccaattccctgggttccgccattacggccgttttgattgaaaacgctattcttacgtcagagaattatgattattttgctaaagaattcgcacacatattctccatttctgcatctaaggtagtaagtgccacctccgcaaaatctgcaagtgaagccaccagtgcttcgtggacagctgcgtcacgtacaggtgctagctccaccactaccgctacctctgaatccggaattacagcttcatcggttgccacaggagctgctgcagccataagtaaaactgcagcaggatcttctagcatcacctatttggccagatcatttagtaggtcattggtgagttatttgttacaaagtgccgaattccactccgttttctactctggaattagttcaggtattgccagtcatattgcttcgacagcaggtacgtctacggctgaatctttggacctggcttccctgaagtccgtgatagcaactgcctgtggtaaagctatggcggctactaactctgatggtggaccacacgcctttgccaattccctgggttccgccattacggccgttttgattgaaaacgctattcttacgtcagagaattatgattattttgctaaagaattcgcacacatattctccatttctgcatctaaggtagtaagtgccacctccgcaaaatctgcaagtgaagccaccagtgcttcgtggacagctgcgtcacgtacaggtgactacaaagatgacgacgataaagattacaaagacgatgacgataaggactataaagatgatgacgacaaataataa

SEQ ID NO: 1447 - DNA, 2136 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtggaggttatggaagaggtcaaggtgctggagctggtgttggagctggagccggtgccgcagctggagcagccgctatcgccagagccggtggttacggtcagggagccggaggatatggtcaaggtcaaggagcaggagctgctgcgggtgccgccgctggagcaggcgctggtggctatggtcaaggtgccggtggttatggtaggggccaaggtgcaggtgcaggagcaggtgccggtgccggtgctaggggttacggtcagggtgcaggtgccggcgctgctgccggagccgctgctagcgctggtgctggaggttatggtcaaggtgctggcggttacggccaaggtcaaggtgccggagctgctgctggcgccgctgcttctgccggagctggcggatacggacaaggtgctggaggatacggtcagggtcaaggagcaggtggaggttatggaagaggtcaaggtgctggagctggtgttggagctggagccggtgccgcagctggagcagccgctatcgccagagccggtggttacggtcagggagccggaggatatggtcaaggtcaaggagcaggagctgctgcgggtgccgccgctggagcaggcgctggtggctatggtcaaggtgccggtggttatggtaggggccaaggtgcaggtgcaggagcaggtgccggtgccggtgctaggggttacggtcagggtgcaggtgccggcgctgctgccggagccgctgctagcgctggtgctggaggttatggtcaaggtgctggcggttacggccaaggtcaaggtgccggagctgctgctggcgccgctgcttctgccggagctggcggatacggacaaggtgctggaggatacggtcagggtcaaggagcaggtggaggttatggaagaggtcaaggtgctggagctggtgttggagctggagccggtgccgcagctggagcagccgctatcgccagagccggtggttacggtcagggagccggaggatatggtcaaggtcaaggagcaggagctgctgcgggtgccgccgctggagcaggcgctggtggctatggtcaaggtgccggtggttatggtaggggccaaggtgcaggtgcaggagcaggtgccggtgccggtgctaggggttacggtcagggtgcaggtgccggcgctgctgccggagccgctgctagcgctggtgctggaggttatggtcaaggtgctggcggttacggccaaggtcaaggtgccggagctgctgctggcgccgctgcttctgccggagctggcggatacggacaaggtgctggaggatacggtcagggtcaaggagcaggtggaggttatggaagaggtcaaggtgctggagctggtgttggagctggagccggtgccgcagctggagcagccgctatcgccagagccggtggttacggtcagggagccggaggatatggtcaaggtcaaggagcaggagctgctgcgggtgccgccgctggagcaggcgctggtggctatggtcaaggtgccggtggttatggtaggggccaaggtgcaggtgcaggagcaggtgccggtgccggtgctaggggttacggtcagggtgcaggtgccggcgctgctgccggagccgctgctagcgctggtgctggaggttatggtcaaggtgctggcggttacggccaaggtcaaggtgccggagctgctgctggcgccgctgcttctgccggagctggcggatacggacaaggtgctggaggatacggtcagggtcaaggagcaggtgactacaaagatgacgacgataaagattacaaagacgatgacgataaggactataaagatgatgacgacaaataataa

SEQ ID NO: 1448 - DNA, 2784 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtggaggtgttggatctcttacaggacaaacgagtttcggtcaaacctctggcttcacaagtaccgctggagctcaaggaggattcggtccgactacaggtgctcagtccgcattgatcagtcgaatcgccaatgcattggccaatacctctaccttgagatctgtcttgagaactggtgtaagtcaacagacagcatctagtgttgttcagcgagctattcaaacgctagccagtaatttaggtatagatggcaataacttgagtaggattgccctgcaagcaatatcccaagtaccagcaggttctgacacctccgcttatgcacaggctttcagtacagctctggtgactggcggcgttttaaacgccaacaacgttgatactttgggatcacaagtgctgtccgccgtgttaaacggagtttcatcggcagcacagggtcttggtatcaacgtggacactggtagcgttcaatcagatatccgatcatcaagttccagtctgtctacatcttcctcgtcggctagtttctctcagacttcaggtgctgcttctaccacaggttttaccggtgctggtggttaccctggaggtgcaggtcctctaggtggaggtgttggatctcttacaggacaaacgagtttcggtcaaacctctggcttcacaagtaccgctggagctcaaggaggattcggtccgactacaggtgctcagtccgcattgatcagtcgaatcgccaatgcattggccaatacctctaccttgagatctgtcttgagaactggtgtaagtcaacagacagcatctagtgttgttcagcgagctattcaaacgctagccagtaatttaggtatagatggcaataacttgagtaggattgccctgcaagcaatatcccaagtaccagcaggttctgacacctccgcttatgcacaggctttcagtacagctctggtgactggcggcgttttaaacgccaacaacgttgatactttgggatcacaagtgctgtccgccgtgttaaacggagtttcatcggcagcacagggtcttggtatcaacgtggacactggtagcgttcaatcagatatccgatcatcaagttccagtctgtctacatcttcctcgtcggctagtttctctcagacttcaggtgctgcttctaccacaggttttaccggtgctggtggttaccctggaggtgcaggtcctctaggtggaggtgttggatctcttacaggacaaacgagtttcggtcaaacctctggcttcacaagtaccgctggagctcaaggaggattcggtccgactacaggtgctcagtccgcattgatcagtcgaatcgccaatgcattggccaatacctctaccttgagatctgtcttgagaactggtgtaagtcaacagacagcatctagtgttgttcagcgagctattcaaacgctagccagtaatttaggtatagatggcaataacttgagtaggattgccctgcaagcaatatcccaagtaccagcaggttctgacacctccgcttatgcacaggctttcagtacagctctggtgactggcggcgttttaaacgccaacaacgttgatactttgggatcacaagtgctgtccgccgtgttaaacggagtttcatcggcagcacagggtcttggtatcaacgtggacactggtagcgttcaatcagatatccgatcatcaagttccagtctgtctacatcttcctcgtcggctagtttctctcagacttcaggtgctgcttctaccacaggttttaccggtgctggtggttaccctggaggtgcaggtcctctaggtggaggtgttggatctcttacaggacaaacgagtttcggtcaaacctctggcttcacaagtaccgctggagctcaaggaggattcggtccgactacaggtgctcagtccgcattgatcagtcgaatcgccaatgcattggccaatacctctaccttgagatctgtcttgagaactggtgtaagtcaacagacagcatctagtgttgttcagcgagctattcaaacgctagccagtaatttaggtatagatggcaataacttgagtaggattgccctgcaagcaatatcccaagtaccagcaggttctgacacctccgcttatgcacaggctttcagtacagctctggtgactggcggcgttttaaacgccaacaacgttgatactttgggatcacaagtgctgtccgccgtgttaaacggagtttcatcggcagcacagggtcttggtatcaacgtggacactggtagcgttcaatcagatatccgatcatcaagttccagtctgtctacatcttcctcgtcggctagtttctctcagacttcaggtgctgcttctaccacaggttttaccggtgctggtggttaccctggaggtgcaggtcctctaggtgactacaaagatgacgacgataaagattacaaagacgatgacgataaggactataaagatgatgacgacaaataataa

SEQ ID NO: 1449 - DNA, 2508 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtagcttggcaagctctttcgcctcagctctgtccgcatccgctgcttcagtcgctagctcagcagctgcacagagtgcttctcaaagtcaagctgcagcctctgccttcagtagagccgcttcgcagagtgcatctcagagtgccgcgaggtctggagcacaatcttccagtactacaacaactacgtctgcttccggatcacaagccgcctcgcaatccgcctccagtgctgcgtcacaagcttcagcttcttcatttgcacaggcctcctctgcatctctcgcagcttcctcttcgttctcttcagcattttcttcggctaacagtttgtctgctcttggtaacgtcgcatatcaactcggtttcaacgttgctaacaccctaggtattggtaatgcaccaggactcggtgccgccctttcacaggcagtgagctctgtcggcgtcggtgcatcatcaagtacttacgccaatgtcgtgtctaatgctgtgggacagtttttagcaggacaaggtgtcctgaatgctgcaaatgcaggtagcttggcaagctctttcgcctcagctctgtccgcatccgctgcttcagtcgctagctcagcagctgcacagagtgcttctcaaagtcaagctgcagcctctgccttcagtagagccgcttcgcagagtgcatctcagagtgccgcgaggtctggagcacaatcttccagtactacaacaactacgtctgcttccggatcacaagccgcctcgcaatccgcctccagtgctgcgtcacaagcttcagcttcttcatttgcacaggcctcctctgcatctctcgcagcttcctcttcgttctcttcagcattttcttcggctaacagtttgtctgctcttggtaacgtcgcatatcaactcggtttcaacgttgctaacaccctaggtattggtaatgcaccaggactcggtgccgccctttcacaggcagtgagctctgtcggcgtcggtgcatcatcaagtacttacgccaatgtcgtgtctaatgctgtgggacagtttttagcaggacaaggtgtcctgaatgctgcaaatgcaggtagcttggcaagctctttcgcctcagctctgtccgcatccgctgcttcagtcgctagctcagcagctgcacagagtgcttctcaaagtcaagctgcagcctctgccttcagtagagccgcttcgcagagtgcatctcagagtgccgcgaggtctggagcacaatcttccagtactacaacaactacgtctgcttccggatcacaagccgcctcgcaatccgcctccagtgctgcgtcacaagcttcagcttcttcatttgcacaggcctcctctgcatctctcgcagcttcctcttcgttctcttcagcattttcttcggctaacagtttgtctgctcttggtaacgtcgcatatcaactcggtttcaacgttgctaacaccctaggtattggtaatgcaccaggactcggtgccgccctttcacaggcagtgagctctgtcggcgtcggtgcatcatcaagtacttacgccaatgtcgtgtctaatgctgtgggacagtttttagcaggacaaggtgtcctgaatgctgcaaatgcaggtagcttggcaagctctttcgcctcagctctgtccgcatccgctgcttcagtcgctagctcagcagctgcacagagtgcttctcaaagtcaagctgcagcctctgccttcagtagagccgcttcgcagagtgcatctcagagtgccgcgaggtctggagcacaatcttccagtactacaacaactacgtctgcttccggatcacaagccgcctcgcaatccgcctccagtgctgcgtcacaagcttcagcttcttcatttgcacaggcctcctctgcatctctcgcagcttcctcttcgttctcttcagcattttcttcggctaacagtttgtctgctcttggtaacgtcgcatatcaactcggtttcaacgttgctaacaccctaggtattggtaatgcaccaggactcggtgccgccctttcacaggcagtgagctctgtcggcgtcggtgcatcatcaagtacttacgccaatgtcgtgtctaatgctgtgggacagtttttagcaggacaaggtgtcctgaatgctgcaaatgcaggtgactacaaagatgacgacgataaagattacaaagacgatgacgataaggactataaagatgatgacgacaaataataa

SEQ ID NO: 1450 - DNA, 2508 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtgctgcgtctgccgccggtgcaagcagtgcagcagcagcatccgcctcggcggcagcagcgagcttcacacaaaatttgatttacagcttgcaagaatccgaaattttttattctgcattaaggagtattgcctcttccggtgaagccagtaacctggcatacttggcagctgagcgagctgcttatggagctggactagacggtattgcaagctcagttgcttcagctgctgcgagcgctttcgctaataccgctttaggttctggagcagccgcctatgcgaaggccctagcatatgctatagcccctgttttaactcgagccaatattattaccctttctaatgctgcctctttggctaccacatatgcaaagggattcgcatctagtgcagccagtgccgcggcctcagccagcgctgcttccgccgctgctgcaagctccgctgcctccgcttcctcagccgcagccgctgcggcggcttcttccagcactagtacaagtactacagtctctcgatctacagccgcagctgcaggtgctgcgtctgccgccggtgcaagcagtgcagcagcagcatccgcctcggcggcagcagcgagcttcacacaaaatttgatttacagcttgcaagaatccgaaattttttattctgcattaaggagtattgcctcttccggtgaagccagtaacctggcatacttggcagctgagcgagctgcttatggagctggactagacggtattgcaagctcagttgcttcagctgctgcgagcgctttcgctaataccgctttaggttctggagcagccgcctatgcgaaggccctagcatatgctatagcccctgttttaactcgagccaatattattaccctttctaatgctgcctctttggctaccacatatgcaaagggattcgcatctagtgcagccagtgccgcggcctcagccagcgctgcttccgccgctgctgcaagctccgctgcctccgcttcctcagccgcagccgctgcggcggcttcttccagcactagtacaagtactacagtctctcgatctacagccgcagctgcaggtgctgcgtctgccgccggtgcaagcagtgcagcagcagcatccgcctcggcggcagcagcgagcttcacacaaaatttgatttacagcttgcaagaatccgaaattttttattctgcattaaggagtattgcctcttccggtgaagccagtaacctggcatacttggcagctgagcgagctgcttatggagctggactagacggtattgcaagctcagttgcttcagctgctgcgagcgctttcgctaataccgctttaggttctggagcagccgcctatgcgaaggccctagcatatgctatagcccctgttttaactcgagccaatattattaccctttctaatgctgcctctttggctaccacatatgcaaagggattcgcatctagtgcagccagtgccgcggcctcagccagcgctgcttccgccgctgctgcaagctccgctgcctccgcttcctcagccgcagccgctgcggcggcttcttccagcactagtacaagtactacagtctctcgatctacagccgcagctgcaggtgctgcgtctgccgccggtgcaagcagtgcagcagcagcatccgcctcggcggcagcagcgagcttcacacaaaatttgatttacagcttgcaagaatccgaaattttttattctgcattaaggagtattgcctcttccggtgaagccagtaacctggcatacttggcagctgagcgagctgcttatggagctggactagacggtattgcaagctcagttgcttcagctgctgcgagcgctttcgctaataccgctttaggttctggagcagccgcctatgcgaaggccctagcatatgctatagcccctgttttaactcgagccaatattattaccctttctaatgctgcctctttggctaccacatatgcaaagggattcgcatctagtgcagccagtgccgcggcctcagccagcgctgcttccgccgctgctgcaagctccgctgcctccgcttcctcagccgcagccgctgcggcggcttcttccagcactagtacaagtactacagtctctcgatctacagccgcagctgcaggtgactacaaagatgacgacgataaagattacaaagacgatgacgataaggactataaagatgatgacgacaaataataa

SEQ ID NO: 1451 - DNA, 2316 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtgccggagcgggaggtgccggaggatacggagccggtcaaggatacggtgccggcgccggcgcaggagcagctgccggagccggtgctggaggagctagaggttacggagcgagacaaggatacggcagtggtgccggtgcaggtgctggagcaagagctggtggagccggaggatacggtagaggagccggagccggtgcagctgccgcctcaggagctggtgctggaggatacggcgctggtcaaggttatggagccggtgctggcgcagtggcctccgctgctgccggtgccggatccggagcaggaggcgctggtggctatggaagaggtgccggagctgtagccggcgctggagctggtggtgctggtggttacggcgctggcgcaggtgctgctgcaggagtaggtgcaggaggaagcggaggttacggtggacgtcaaggcggttattctgctggtgctggtgcgggtgcagcagccgctgcaggtgccggagcgggaggtgccggaggatacggagccggtcaaggatacggtgccggcgccggcgcaggagcagctgccggagccggtgctggaggagctagaggttacggagcgagacaaggatacggcagtggtgccggtgcaggtgctggagcaagagctggtggagccggaggatacggtagaggagccggagccggtgcagctgccgcctcaggagctggtgctggaggatacggcgctggtcaaggttatggagccggtgctggcgcagtggcctccgctgctgccggtgccggatccggagcaggaggcgctggtggctatggaagaggtgccggagctgtagccggcgctggagctggtggtgctggtggttacggcgctggcgcaggtgctgctgcaggagtaggtgcaggaggaagcggaggttacggtggacgtcaaggcggttattctgctggtgctggtgcgggtgcagcagccgctgcaggtgccggagcgggaggtgccggaggatacggagccggtcaaggatacggtgccggcgccggcgcaggagcagctgccggagccggtgctggaggagctagaggttacggagcgagacaaggatacggcagtggtgccggtgcaggtgctggagcaagagctggtggagccggaggatacggtagaggagccggagccggtgcagctgccgcctcaggagctggtgctggaggatacggcgctggtcaaggttatggagccggtgctggcgcagtggcctccgctgctgccggtgccggatccggagcaggaggcgctggtggctatggaagaggtgccggagctgtagccggcgctggagctggtggtgctggtggttacggcgctggcgcaggtgctgctgcaggagtaggtgcaggaggaagcggaggttacggtggacgtcaaggcggttattctgctggtgctggtgcgggtgcagcagccgctgcaggtgccggagcgggaggtgccggaggatacggagccggtcaaggatacggtgccggcgccggcgcaggagcagctgccggagccggtgctggaggagctagaggttacggagcgagacaaggatacggcagtggtgccggtgcaggtgctggagcaagagctggtggagccggaggatacggtagaggagccggagccggtgcagctgccgcctcaggagctggtgctggaggatacggcgctggtcaaggttatggagccggtgctggcgcagtggcctccgctgctgccggtgccggatccggagcaggaggcgctggtggctatggaagaggtgccggagctgtagccggcgctggagctggtggtgctggtggttacggcgctggcgcaggtgctgctgcaggagtaggtgcaggaggaagcggaggttacggtggacgtcaaggcggttattctgctggtgctggtgcgggtgcagcagccgctgcaggtgactacaaagatgacgacgataaagattacaaagacgatgacgataaggactataaagatgatgacgacaaataataa

SEQ ID NO: 1452 - DNA, 2748 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtgcaggttacacgggaccatccggcccatcgactggtccatccggttacccaggtcctctaggtggtggagctccatttggacaaagtggcttcggaggtagtgatggtcctcaaggcggttttggtgccaccggtggtgctagcgctggtttaatctcacgagttgctaacgctttggccaacacttccacactaagaactgtacttagaactggagtgtctcaacagatagcaagtagtgttgtccagagagcagcacaatctcttgctagtactttaggcgttgacggcaataatctcgccagattcgcagttcaagcagtttccagattgcccgctggatctgatacttcagcatacgcacaggcattcagtagcgccctgtttaatgccggtgtgttgaatgccagtaacatcgacaccctaggtagtagagtcctgtccgctttactaaacggtgtaagctcagctgctcaaggtttgggcatcaacgtggattctggttctgttcaaagtgatatttcgtcatcttcaagtttcttgtctaccagcagctcctcggcttcttactctcaagctagtgccagttctacttcaggtgcaggttacacgggaccatccggcccatcgactggtccatccggttacccaggtcctctaggtggtggagctccatttggacaaagtggcttcggaggtagtgatggtcctcaaggcggttttggtgccaccggtggtgctagcgctggtttaatctcacgagttgctaacgctttggccaacacttccacactaagaactgtacttagaactggagtgtctcaacagatagcaagtagtgttgtccagagagcagcacaatctcttgctagtactttaggcgttgacggcaataatctcgccagattcgcagttcaagcagtttccagattgcccgctggatctgatacttcagcatacgcacaggcattcagtagcgccctgtttaatgccggtgtgttgaatgccagtaacatcgacaccctaggtagtagagtcctgtccgctttactaaacggtgtaagctcagctgctcaaggtttgggcatcaacgtggattctggttctgttcaaagtgatatttcgtcatcttcaagtttcttgtctaccagcagctcctcggcttcttactctcaagctagtgccagttctacttcaggtgcaggttacacgggaccatccggcccatcgactggtccatccggttacccaggtcctctaggtggtggagctccatttggacaaagtggcttcggaggtagtgatggtcctcaaggcggttttggtgccaccggtggtgctagcgctggtttaatctcacgagttgctaacgctttggccaacacttccacactaagaactgtacttagaactggagtgtctcaacagatagcaagtagtgttgtccagagagcagcacaatctcttgctagtactttaggcgttgacggcaataatctcgccagattcgcagttcaagcagtttccagattgcccgctggatctgatacttcagcatacgcacaggcattcagtagcgccctgtttaatgccggtgtgttgaatgccagtaacatcgacaccctaggtagtagagtcctgtccgctttactaaacggtgtaagctcagctgctcaaggtttgggcatcaacgtggattctggttctgttcaaagtgatatttcgtcatcttcaagtttcttgtctaccagcagctcctcggcttcttactctcaagctagtgccagttctacttcaggtgcaggttacacgggaccatccggcccatcgactggtccatccggttacccaggtcctctaggtggtggagctccatttggacaaagtggcttcggaggtagtgatggtcctcaaggcggttttggtgccaccggtggtgctagcgctggtttaatctcacgagttgctaacgctttggccaacacttccacactaagaactgtacttagaactggagtgtctcaacagatagcaagtagtgttgtccagagagcagcacaatctcttgctagtactttaggcgttgacggcaataatctcgccagattcgcagttcaagcagtttccagattgcccgctggatctgatacttcagcatacgcacaggcattcagtagcgccctgtttaatgccggtgtgttgaatgccagtaacatcgacaccctaggtagtagagtcctgtccgctttactaaacggtgtaagctcagctgctcaaggtttgggcatcaacgtggattctggttctgttcaaagtgatatttcgtcatcttcaagtttcttgtctaccagcagctcctcggcttcttactctcaagctagtgccagttctacttcaggtgactacaaagatgacgacgataaagattacaaagacgatgacgataaggactataaagatgatgacgacaaataataa

SEQ ID NO: 1453 - DNA, 3684 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggttctcaagctggaagtcaagctggatcgcaagcaggtagtcaggcaggttctcaggctgctagtcaggccggctctcaatccgcatctcaagcttcagcttcttctagcgcttctgcatttgcttctgcttcggcatttgctcaatctgcctctttcgctcttagttcgtcctcatcatttgctagcgcagtttcaagcgcttcatcggtttcagcattgggcaccttgggataccaagtaggactgcaggcggcaggatcactaggaatttctaattcacaggcttttgcgtcaagtatttcgcaggccttaactagcgttggagttggcgcatctagttctgcgtatgcctctgccgtgtccggagtggtcgcccagtacctgtctggcactggtgtgttaacttctgctaatgcgcaagcacttgcatcatcatttgctaatgtttttgcagctagtgctgcgagcgcttccgcagctgcctcagcttcttcagccgccagcgctcaatcagccgctgccgccttggcccaatcgcagtccgcagcctcagcatttagccaggcagcctcacaggccttctcacaagcggcttctcaggctggctctcaagccgcctcacaagctggtagtcaagccgcatcacaggcaggatcccaagctgcatctcaggctggatctcaagctgcctcccaagcaggtagccaggctgcttcgcaatctggtagtggagcttcctcatttacgactactatttctcgttcatctgctggtagtcagacgggtagtcaagctggttcacaagccggttcacaggctggatcacaagcaggttctcaagctggaagtcaagctggatcgcaagcaggtagtcaggcaggttctcaggctgctagtcaggccggctctcaatccgcatctcaagcttcagcttcttctagcgcttctgcatttgcttctgcttcggcatttgctcaatctgcctctttcgctcttagttcgtcctcatcatttgctagcgcagtttcaagcgcttcatcggtttcagcattgggcaccttgggataccaagtaggactgcaggcggcaggatcactaggaatttctaattcacaggcttttgcgtcaagtatttcgcaggccttaactagcgttggagttggcgcatctagttctgcgtatgcctctgccgtgtccggagtggtcgcccagtacctgtctggcactggtgtgttaacttctgctaatgcgcaagcacttgcatcatcatttgctaatgtttttgcagctagtgctgcgagcgcttccgcagctgcctcagcttcttcagccgccagcgctcaatcagccgctgccgccttggcccaatcgcagtccgcagcctcagcatttagccaggcagcctcacaggccttctcacaagcggcttctcaggctggctctcaagccgcctcacaagctggtagtcaagccgcatcacaggcaggatcccaagctgcatctcaggctggatctcaagctgcctcccaagcaggtagccaggctgcttcgcaatctggtagtggagcttcctcatttacgactactatttctcgttcatctgctggtagtcagacgggtagtcaagctggttcacaagccggttcacaggctggatcacaagcaggttctcaagctggaagtcaagctggatcgcaagcaggtagtcaggcaggttctcaggctgctagtcaggccggctctcaatccgcatctcaagcttcagcttcttctagcgcttctgcatttgcttctgcttcggcatttgctcaatctgcctctttcgctcttagttcgtcctcatcatttgctagcgcagtttcaagcgcttcatcggtttcagcattgggcaccttgggataccaagtaggactgcaggcggcaggatcactaggaatttctaattcacaggcttttgcgtcaagtatttcgcaggccttaactagcgttggagttggcgcatctagttctgcgtatgcctctgccgtgtccggagtggtcgcccagtacctgtctggcactggtgtgttaacttctgctaatgcgcaagcacttgcatcatcatttgctaatgtttttgcagctagtgctgcgagcgcttccgcagctgcctcagcttcttcagccgccagcgctcaatcagccgctgccgccttggcccaatcgcagtccgcagcctcagcatttagccaggcagcctcacaggccttctcacaagcggcttctcaggctggctctcaagccgcctcacaagctggtagtcaagccgcatcacaggcaggatcccaagctgcatctcaggctggatctcaagctgcctcccaagcaggtagccaggctgcttcgcaatctggtagtggagcttcctcatttacgactactatttctcgttcatctgctggtagtcagacgggtagtcaagctggttcacaagccggttcacaggctggatcacaagcaggttctcaagctggaagtcaagctggatcgcaagcaggtagtcaggcaggttctcaggctgctagtcaggccggctctcaatccgcatctcaagcttcagcttcttctagcgcttctgcatttgcttctgcttcggcatttgctcaatctgcctctttcgctcttagttcgtcctcatcatttgctagcgcagtttcaagcgcttcatcggtttcagcattgggcaccttgggataccaagtaggactgcaggcggcaggatcactaggaatttctaattcacaggcttttgcgtcaagtatttcgcaggccttaactagcgttggagttggcgcatctagttctgcgtatgcctctgccgtgtccggagtggtcgcccagtacctgtctggcactggtgtgttaacttctgctaatgcgcaagcacttgcatcatcatttgctaatgtttttgcagctagtgctgcgagcgcttccgcagctgcctcagcttcttcagccgccagcgctcaatcagccgctgccgccttggcccaatcgcagtccgcagcctcagcatttagccaggcagcctcacaggccttctcacaagcggcttctcaggctggctctcaagccgcctcacaagctggtagtcaagccgcatcacaggcaggatcccaagctgcatctcaggctggatctcaagctgcctcccaagcaggtagccaggctgcttcgcaatctggtagtggagcttcctcatttacgactactatttctcgttcatctgctggtagtcagacgggtagtcaagctggttcacaagccggttcacaggctggatcacaagcaggtgactacaaagatgacgacgataaagattacaaagacgatgacgataaggactataaagatgatgacgacaaataataa

SEQ ID NO: 1454 - DNA, 2376 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtgctggagccggcgctggagctggcgccggagcaggctattcggccggcgctggttacggtattggagctggagccggagtgggcgctggtgctggtgcaggcgcaggtgccggatctggtaccggtactggagccggatatggttacggatcttcaacccaatctagctccaccatttacgctgctacctaccagggtggttatggacgagttgcaggcctgggtgccggagctggtgcaggtgcaggtgcaggaggaggtgcaggtgccggagcaggtacaggtgccggagctggagcaggaataggtgctggttatggtgctggcgcgggttatggagccggagctggaaccggctccggagcaggtgccggtgcaggaggaggcgcagcagctggtgctggttcgggtgttggtgcaggctacggtgcaggagctggctatggagccggagccggagccggtggtggagcaggtgcaggagccggaagcggtgcttcagcaggtgctggagccggcgctggagctggcgccggagcaggctattcggccggcgctggttacggtattggagctggagccggagtgggcgctggtgctggtgcaggcgcaggtgccggatctggtaccggtactggagccggatatggttacggatcttcaacccaatctagctccaccatttacgctgctacctaccagggtggttatggacgagttgcaggcctgggtgccggagctggtgcaggtgcaggtgcaggaggaggtgcaggtgccggagcaggtacaggtgccggagctggagcaggaataggtgctggttatggtgctggcgcgggttatggagccggagctggaaccggctccggagcaggtgccggtgcaggaggaggcgcagcagctggtgctggttcgggtgttggtgcaggctacggtgcaggagctggctatggagccggagccggagccggtggtggagcaggtgcaggagccggaagcggtgcttcagcaggtgctggagccggcgctggagctggcgccggagcaggctattcggccggcgctggttacggtattggagctggagccggagtgggcgctggtgctggtgcaggcgcaggtgccggatctggtaccggtactggagccggatatggttacggatcttcaacccaatctagctccaccatttacgctgctacctaccagggtggttatggacgagttgcaggcctgggtgccggagctggtgcaggtgcaggtgcaggaggaggtgcaggtgccggagcaggtacaggtgccggagctggagcaggaataggtgctggttatggtgctggcgcgggttatggagccggagctggaaccggctccggagcaggtgccggtgcaggaggaggcgcagcagctggtgctggttcgggtgttggtgcaggctacggtgcaggagctggctatggagccggagccggagccggtggtggagcaggtgcaggagccggaagcggtgcttcagcaggtgctggagccggcgctggagctggcgccggagcaggctattcggccggcgctggttacggtattggagctggagccggagtgggcgctggtgctggtgcaggcgcaggtgccggatctggtaccggtactggagccggatatggttacggatcttcaacccaatctagctccaccatttacgctgctacctaccagggtggttatggacgagttgcaggcctgggtgccggagctggtgcaggtgcaggtgcaggaggaggtgcaggtgccggagcaggtacaggtgccggagctggagcaggaataggtgctggttatggtgctggcgcgggttatggagccggagctggaaccggctccggagcaggtgccggtgcaggaggaggcgcagcagctggtgctggttcgggtgttggtgcaggctacggtgcaggagctggctatggagccggagccggagccggtggtggagcaggtgcaggagccggaagcggtgcttcagcaggtgactacaaagatgacgacgataaagattacaaagacgatgacgataaggactataaagatgatgacgacaaataataa

SEQ ID NO: 1455 - DNA, 2436 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtagtggatacggagcaggcgcaggtgctggtgccggcagtggttacggtgccggagccggtgctggaagcggttatggcgcaggagctggagctggtgctggctcaggctacgttgccggagcaggagcaggtgcaggtgctggttctggatatggagctggagcaggcgctggagctggttcctcatattccgctggtgcaggagccggtgctggttctggttatggcgctggtagttctgcttctgccggctcagccgtctcaacacaaactgtttccagttcagcaacgacctcgtcacagagtgccgcagctgctactggagcagcatacggtacccgagcatcaactggaagtggtgcttctgctggagctgcagcatcaggtgctggagctggttacggaggtcaggccggttatggtcaaggaggaggagctgcagcctatagagctggcgcaggatcccaggccgcttatggacaaggtgcctcgggctcatctggtgcggcagctgcagcaggtagtggatacggagcaggcgcaggtgctggtgccggcagtggttacggtgccggagccggtgctggaagcggttatggcgcaggagctggagctggtgctggctcaggctacgttgccggagcaggagcaggtgcaggtgctggttctggatatggagctggagcaggcgctggagctggttcctcatattccgctggtgcaggagccggtgctggttctggttatggcgctggtagttctgcttctgccggctcagccgtctcaacacaaactgtttccagttcagcaacgacctcgtcacagagtgccgcagctgctactggagcagcatacggtacccgagcatcaactggaagtggtgcttctgctggagctgcagcatcaggtgctggagctggttacggaggtcaggccggttatggtcaaggaggaggagctgcagcctatagagctggcgcaggatcccaggccgcttatggacaaggtgcctcgggctcatctggtgcggcagctgcagcaggtagtggatacggagcaggcgcaggtgctggtgccggcagtggttacggtgccggagccggtgctggaagcggttatggcgcaggagctggagctggtgctggctcaggctacgttgccggagcaggagcaggtgcaggtgctggttctggatatggagctggagcaggcgctggagctggttcctcatattccgctggtgcaggagccggtgctggttctggttatggcgctggtagttctgcttctgccggctcagccgtctcaacacaaactgtttccagttcagcaacgacctcgtcacagagtgccgcagctgctactggagcagcatacggtacccgagcatcaactggaagtggtgcttctgctggagctgcagcatcaggtgctggagctggttacggaggtcaggccggttatggtcaaggaggaggagctgcagcctatagagctggcgcaggatcccaggccgcttatggacaaggtgcctcgggctcatctggtgcggcagctgcagcaggtagtggatacggagcaggcgcaggtgctggtgccggcagtggttacggtgccggagccggtgctggaagcggttatggcgcaggagctggagctggtgctggctcaggctacgttgccggagcaggagcaggtgcaggtgctggttctggatatggagctggagcaggcgctggagctggttcctcatattccgctggtgcaggagccggtgctggttctggttatggcgctggtagttctgcttctgccggctcagccgtctcaacacaaactgtttccagttcagcaacgacctcgtcacagagtgccgcagctgctactggagcagcatacggtacccgagcatcaactggaagtggtgcttctgctggagctgcagcatcaggtgctggagctggttacggaggtcaggccggttatggtcaaggaggaggagctgcagcctatagagctggcgcaggatcccaggccgcttatggacaaggtgcctcgggctcatctggtgcggcagctgcagcaggtgactacaaagatgacgacgataaagattacaaagacgatgacgataaggactataaagatgatgacgacaaataataa

SEQ ID NO: 1456 - DNA, 2184 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtgctggcgccggcggagctggaggttatggacgaggcgccggagcaggtgccggagctgctgctggagcaggtgctggtgctgctgcaggtgcgggcgcaggtggttacggtggtcaaggcggctacggagctggtgccggagcaggtgctgctgcagctgctggcgccggagcaggaggcgctggaggatacggaaggggcgctggtgctggagctggtgtcgcagcaggtgcaggcgccggaggatacggtggacaaggtggatatggagccggtgcgggagcgggagcagcagctgccgcagctactggtgcaggtggtgctggtggttatggtcgtggagctggtgctggagcaggagctgcagcaggagctggagccggtactggtggcgctggatacggaggtcagggaggttacggagctggcgccggagctggagctgccgctgctgcaggtgctggcgccggcggagctggaggttatggacgaggcgccggagcaggtgccggagctgctgctggagcaggtgctggtgctgctgcaggtgcgggcgcaggtggttacggtggtcaaggcggctacggagctggtgccggagcaggtgctgctgcagctgctggcgccggagcaggaggcgctggaggatacggaaggggcgctggtgctggagctggtgtcgcagcaggtgcaggcgccggaggatacggtggacaaggtggatatggagccggtgcgggagcgggagcagcagctgccgcagctactggtgcaggtggtgctggtggttatggtcgtggagctggtgctggagcaggagctgcagcaggagctggagccggtactggtggcgctggatacggaggtcagggaggttacggagctggcgccggagctggagctgccgctgctgcaggtgctggcgccggcggagctggaggttatggacgaggcgccggagcaggtgccggagctgctgctggagcaggtgctggtgctgctgcaggtgcgggcgcaggtggttacggtggtcaaggcggctacggagctggtgccggagcaggtgctgctgcagctgctggcgccggagcaggaggcgctggaggatacggaaggggcgctggtgctggagctggtgtcgcagcaggtgcaggcgccggaggatacggtggacaaggtggatatggagccggtgcgggagcgggagcagcagctgccgcagctactggtgcaggtggtgctggtggttatggtcgtggagctggtgctggagcaggagctgcagcaggagctggagccggtactggtggcgctggatacggaggtcagggaggttacggagctggcgccggagctggagctgccgctgctgcaggtgctggcgccggcggagctggaggttatggacgaggcgccggagcaggtgccggagctgctgctggagcaggtgctggtgctgctgcaggtgcgggcgcaggtggttacggtggtcaaggcggctacggagctggtgccggagcaggtgctgctgcagctgctggcgccggagcaggaggcgctggaggatacggaaggggcgctggtgctggagctggtgtcgcagcaggtgcaggcgccggaggatacggtggacaaggtggatatggagccggtgcgggagcgggagcagcagctgccgcagctactggtgcaggtggtgctggtggttatggtcgtggagctggtgctggagcaggagctgcagcaggagctggagccggtactggtggcgctggatacggaggtcagggaggttacggagctggcgccggagctggagctgccgctgctgcaggtgactacaaagatgacgacgataaagattacaaagacgatgacgataaggactataaagatgatgacgacaaataataa

SEQ ID NO: 1457 - DNA, 3216 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtgctgcgcagaaacagccatcaggagagtctagtgttgccactgcaagcgcggctgcaacctcagtgacctcaggtggagcaccagttggaaagccaggtgtcccagcaccaatattttaccctcaaggtccgttacagcagggacctgcacctggaccttccaacgtccagcctggtacctctcagcaaggtccgatcggtggcgttggtggctcaaatgcgttttcgtcgtcattcgccagtgccttatccctaaaccgaggttttacagaagttatcagctctgcttccgcaacggctgttgcaagtgcttttcagaagggtctagctccatatggaactgccttcgctctgtcagcagcttccgcggctgctgatgcgtacaacagcattggatccggagctaatgcattcgcatatgctcaagcttttgctagagttctgtatccattggtcagacaatatggactatctagctctggtaaagcatctgcgttcgcctcagctattgcttcttctttctcttccggtacttctggacaaggaccgtccattggacagcaacaaccaccagtaactatttctgccgcctcggcctcagctggagcttcagctgcagccgtaggaggtggtcaagttggtcagggaccgtatggtggacaacaacaatccactgctgcctcagccagtgctgcagcagctactgccacatcaggtgctgcgcagaaacagccatcaggagagtctagtgttgccactgcaagcgcggctgcaacctcagtgacctcaggtggagcaccagttggaaagccaggtgtcccagcaccaatattttaccctcaaggtccgttacagcagggacctgcacctggaccttccaacgtccagcctggtacctctcagcaaggtccgatcggtggcgttggtggctcaaatgcgttttcgtcgtcattcgccagtgccttatccctaaaccgaggttttacagaagttatcagctctgcttccgcaacggctgttgcaagtgcttttcagaagggtctagctccatatggaactgccttcgctctgtcagcagcttccgcggctgctgatgcgtacaacagcattggatccggagctaatgcattcgcatatgctcaagcttttgctagagttctgtatccattggtcagacaatatggactatctagctctggtaaagcatctgcgttcgcctcagctattgcttcttctttctcttccggtacttctggacaaggaccgtccattggacagcaacaaccaccagtaactatttctgccgcctcggcctcagctggagcttcagctgcagccgtaggaggtggtcaagttggtcagggaccgtatggtggacaacaacaatccactgctgcctcagccagtgctgcagcagctactgccacatcaggtgctgcgcagaaacagccatcaggagagtctagtgttgccactgcaagcgcggctgcaacctcagtgacctcaggtggagcaccagttggaaagccaggtgtcccagcaccaatattttaccctcaaggtccgttacagcagggacctgcacctggaccttccaacgtccagcctggtacctctcagcaaggtccgatcggtggcgttggtggctcaaatgcgttttcgtcgtcattcgccagtgccttatccctaaaccgaggttttacagaagttatcagctctgcttccgcaacggctgttgcaagtgcttttcagaagggtctagctccatatggaactgccttcgctctgtcagcagcttccgcggctgctgatgcgtacaacagcattggatccggagctaatgcattcgcatatgctcaagcttttgctagagttctgtatccattggtcagacaatatggactatctagctctggtaaagcatctgcgttcgcctcagctattgcttcttctttctcttccggtacttctggacaaggaccgtccattggacagcaacaaccaccagtaactatttctgccgcctcggcctcagctggagcttcagctgcagccgtaggaggtggtcaagttggtcagggaccgtatggtggacaacaacaatccactgctgcctcagccagtgctgcagcagctactgccacatcaggtgctgcgcagaaacagccatcaggagagtctagtgttgccactgcaagcgcggctgcaacctcagtgacctcaggtggagcaccagttggaaagccaggtgtcccagcaccaatattttaccctcaaggtccgttacagcagggacctgcacctggaccttccaacgtccagcctggtacctctcagcaaggtccgatcggtggcgttggtggctcaaatgcgttttcgtcgtcattcgccagtgccttatccctaaaccgaggttttacagaagttatcagctctgcttccgcaacggctgttgcaagtgcttttcagaagggtctagctccatatggaactgccttcgctctgtcagcagcttccgcggctgctgatgcgtacaacagcattggatccggagctaatgcattcgcatatgctcaagcttttgctagagttctgtatccattggtcagacaatatggactatctagctctggtaaagcatctgcgttcgcctcagctattgcttcttctttctcttccggtacttctggacaaggaccgtccattggacagcaacaaccaccagtaactatttctgccgcctcggcctcagctggagcttcagctgcagccgtaggaggtggtcaagttggtcagggaccgtatggtggacaacaacaatccactgctgcctcagccagtgctgcagcagctactgccacatcaggtgactacaaagatgacgacgataaagattacaaagacgatgacgataaggactataaagatgatgacgacaaataataa

SEQ ID NO: 1458 - DNA, 3564 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtggcgcaccaggtggtggaccaggaggtgccggtccgggcggtgccggatttggacccggaggaggagccggattcggccctggaggaggtgccggtttcggcccaggaggtgctgccggaggaccaggtggtcctggtggacctggaggtccaggtggagctggtggatacggtccaggaggagctggaggatacggaccaggaggtgtcggtcctggtggagctggaggatatggacctggaggtgctggaggttacggtccaggaggttccggtccaggtggtgccggaccgggtggtgccggtggcgagggtccggttactgtagacgttgatgttactgttggacctgaaggagtgggaggaggaccaggtggcgccggtccaggaggtgcaggattcggcccaggtggcggagcgggtttcggtccaggtggcgcccctggagccccaggaggaccaggaggtcctggaggaccgggtggtccaggaggtccaggaggtgtaggaccgggtggagctggaggttacggccctggtggtgctggtggagtaggaccggctggtactggaggattcggtcctggaggagccggtggttttggacctggtggagcaggaggttttggtcctggaggagcaggtggattcggaccaggaggtgctggaggatatggtccaggtggtgttggtcctggtggtgcaggaggttttggacctggaggagttggtccaggaggatcaggacccggaggagctggtggtgaaggaccagtaacagtagatgtagacgtctcagtaggtggcgcaccaggtggtggaccaggaggtgccggtccgggcggtgccggatttggacccggaggaggagccggattcggccctggaggaggtgccggtttcggcccaggaggtgctgccggaggaccaggtggtcctggtggacctggaggtccaggtggagctggtggatacggtccaggaggagctggaggatacggaccaggaggtgtcggtcctggtggagctggaggatatggacctggaggtgctggaggttacggtccaggaggttccggtccaggtggtgccggaccgggtggtgccggtggcgagggtccggttactgtagacgttgatgttactgttggacctgaaggagtgggaggaggaccaggtggcgccggtccaggaggtgcaggattcggcccaggtggcggagcgggtttcggtccaggtggcgcccctggagccccaggaggaccaggaggtcctggaggaccgggtggtccaggaggtccaggaggtgtaggaccgggtggagctggaggttacggccctggtggtgctggtggagtaggaccggctggtactggaggattcggtcctggaggagccggtggttttggacctggtggagcaggaggttttggtcctggaggagcaggtggattcggaccaggaggtgctggaggatatggtccaggtggtgttggtcctggtggtgcaggaggttttggacctggaggagttggtccaggaggatcaggacccggaggagctggtggtgaaggaccagtaacagtagatgtagacgtctcagtaggtggcgcaccaggtggtggaccaggaggtgccggtccgggcggtgccggatttggacccggaggaggagccggattcggccctggaggaggtgccggtttcggcccaggaggtgctgccggaggaccaggtggtcctggtggacctggaggtccaggtggagctggtggatacggtccaggaggagctggaggatacggaccaggaggtgtcggtcctggtggagctggaggatatggacctggaggtgctggaggttacggtccaggaggttccggtccaggtggtgccggaccgggtggtgccggtggcgagggtccggttactgtagacgttgatgttactgttggacctgaaggagtgggaggaggaccaggtggcgccggtccaggaggtgcaggattcggcccaggtggcggagcgggtttcggtccaggtggcgcccctggagccccaggaggaccaggaggtcctggaggaccgggtggtccaggaggtccaggaggtgtaggaccgggtggagctggaggttacggccctggtggtgctggtggagtaggaccggctggtactggaggattcggtcctggaggagccggtggttttggacctggtggagcaggaggttttggtcctggaggagcaggtggattcggaccaggaggtgctggaggatatggtccaggtggtgttggtcctggtggtgcaggaggttttggacctggaggagttggtccaggaggatcaggacccggaggagctggtggtgaaggaccagtaacagtagatgtagacgtctcagtaggtggcgcaccaggtggtggaccaggaggtgccggtccgggcggtgccggatttggacccggaggaggagccggattcggccctggaggaggtgccggtttcggcccaggaggtgctgccggaggaccaggtggtcctggtggacctggaggtccaggtggagctggtggatacggtccaggaggagctggaggatacggaccaggaggtgtcggtcctggtggagctggaggatatggacctggaggtgctggaggttacggtccaggaggttccggtccaggtggtgccggaccgggtggtgccggtggcgagggtccggttactgtagacgttgatgttactgttggacctgaaggagtgggaggaggaccaggtggcgccggtccaggaggtgcaggattcggcccaggtggcggagcgggtttcggtccaggtggcgcccctggagccccaggaggaccaggaggtcctggaggaccgggtggtccaggaggtccaggaggtgtaggaccgggtggagctggaggttacggccctggtggtgctggtggagtaggaccggctggtactggaggattcggtcctggaggagccggtggttttggacctggtggagcaggaggttttggtcctggaggagcaggtggattcggaccaggaggtgctggaggatatggtccaggtggtgttggtcctggtggtgcaggaggttttggacctggaggagttggtccaggaggatcaggacccggaggagctggtggtgaaggaccagtaacagtagatgtagacgtctcagtaggtgactacaaagatgacgacgataaagattacaaagacgatgacgataaggactataaagatgatgacgacaaataataa

SEQ ID NO: 1459 - DNA, 2472 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtagtggtgctgcgagggccgctcagacagcctccgccgcttccgctgcatctgcttcgagttcacttcagcagtcacttggttccgcactcgctcaaagctcaagttttgcggctgcgtttgaccaggctaactcagccgcttcggctgctgcaatcgcttacgccctggctcaatctgctgcaaaccaagtaggactgagctcatattctgcagctatttctaatgctgcggcagctgctgtgggttccgtcggaggctacgcttctgcttcggcttatgcttttgcgtttgcatctggagtttcacaagtgttgagtaactacggattaattaatctatctaacgcattgtttttggccagtagtattgcaaatgcagcaagtgcaagtgcatcctctgccgcagccgcagctagttcttcgagcgcagctacgggcgccgctgctgcactgggtggtgccggtagtgctgcagcaacctccacgactactatcacttcgacctctacggcggtggcagcagcttcaggtagtggtgctgcgagggccgctcagacagcctccgccgcttccgctgcatctgcttcgagttcacttcagcagtcacttggttccgcactcgctcaaagctcaagttttgcggctgcgtttgaccaggctaactcagccgcttcggctgctgcaatcgcttacgccctggctcaatctgctgcaaaccaagtaggactgagctcatattctgcagctatttctaatgctgcggcagctgctgtgggttccgtcggaggctacgcttctgcttcggcttatgcttttgcgtttgcatctggagtttcacaagtgttgagtaactacggattaattaatctatctaacgcattgtttttggccagtagtattgcaaatgcagcaagtgcaagtgcatcctctgccgcagccgcagctagttcttcgagcgcagctacgggcgccgctgctgcactgggtggtgccggtagtgctgcagcaacctccacgactactatcacttcgacctctacggcggtggcagcagcttcaggtagtggtgctgcgagggccgctcagacagcctccgccgcttccgctgcatctgcttcgagttcacttcagcagtcacttggttccgcactcgctcaaagctcaagttttgcggctgcgtttgaccaggctaactcagccgcttcggctgctgcaatcgcttacgccctggctcaatctgctgcaaaccaagtaggactgagctcatattctgcagctatttctaatgctgcggcagctgctgtgggttccgtcggaggctacgcttctgcttcggcttatgcttttgcgtttgcatctggagtttcacaagtgttgagtaactacggattaattaatctatctaacgcattgtttttggccagtagtattgcaaatgcagcaagtgcaagtgcatcctctgccgcagccgcagctagttcttcgagcgcagctacgggcgccgctgctgcactgggtggtgccggtagtgctgcagcaacctccacgactactatcacttcgacctctacggcggtggcagcagcttcaggtagtggtgctgcgagggccgctcagacagcctccgccgcttccgctgcatctgcttcgagttcacttcagcagtcacttggttccgcactcgctcaaagctcaagttttgcggctgcgtttgaccaggctaactcagccgcttcggctgctgcaatcgcttacgccctggctcaatctgctgcaaaccaagtaggactgagctcatattctgcagctatttctaatgctgcggcagctgctgtgggttccgtcggaggctacgcttctgcttcggcttatgcttttgcgtttgcatctggagtttcacaagtgttgagtaactacggattaattaatctatctaacgcattgtttttggccagtagtattgcaaatgcagcaagtgcaagtgcatcctctgccgcagccgcagctagttcttcgagcgcagctacgggcgccgctgctgcactgggtggtgccggtagtgctgcagcaacctccacgactactatcacttcgacctctacggcggtggcagcagcttcaggtgactacaaagatgacgacgataaagattacaaagacgatgacgataaggactataaagatgatgacgacaaataataa

SEQ ID NO: 1460 - DNA, 3576 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtgcaggtggctcaggccctggtggagcaggacctggaggtgccggtcctggaggcgctggacccggcggtgttggaccgggaggagctggaggacctggtggagccggcggtccatttggaccaggtggttccggaccaggtggcgctggtggcgctggtggtccatacggccctggcggagcttatggtccaggtggccctggtggtccaggtggtcctggtggcccaggctctggtggtccttacggaccaggtggagcttacggaccgggtggagcatatggtccaggaggagcatatggaccaggcggagccggaggtccatacggaccaggtggtccttacggccccggaggaccttacggtcccggtggtgcaggtggacccggaggcgccggtggtccatacggacccggtggtgctggtccgggtggatacggtccaggaggcgcaggtccaggaggttatggaccaggcggttctggacctggaggtgcaggacccggtggatatggacccggtggatccggacctggcggagccggacctggtggatatggacctggtggtgcaggtccaggcggttacggacctggtggcgctggacctggcggtgctggtcctggaggtgctggacctggcggatatggcccaggtggttctggtcctggaggacctggttcaggaggaccgggtggagccggaggatcaggcggtacaacagtcatcgaagatttagatattaccgtcaacggcccgggcggaccaatcacaatttctgaagagttgactgtaggaggtccaggtgcaggtggctcaggccctggtggagcaggacctggaggtgccggtcctggaggcgctggacccggcggtgttggaccgggaggagctggaggacctggtggagccggcggtccatttggaccaggtggttccggaccaggtggcgctggtggcgctggtggtccatacggccctggcggagcttatggtccaggtggccctggtggtccaggtggtcctggtggcccaggctctggtggtccttacggaccaggtggagcttacggaccgggtggagcatatggtccaggaggagcatatggaccaggcggagccggaggtccatacggaccaggtggtccttacggccccggaggaccttacggtcccggtggtgcaggtggacccggaggcgccggtggtccatacggacccggtggtgctggtccgggtggatacggtccaggaggcgcaggtccaggaggttatggaccaggcggttctggacctggaggtgcaggacccggtggatatggacccggtggatccggacctggcggagccggacctggtggatatggacctggtggtgcaggtccaggcggttacggacctggtggcgctggacctggcggtgctggtcctggaggtgctggacctggcggatatggcccaggtggttctggtcctggaggacctggttcaggaggaccgggtggagccggaggatcaggcggtacaacagtcatcgaagatttagatattaccgtcaacggcccgggcggaccaatcacaatttctgaagagttgactgtaggaggtccaggtgcaggtggctcaggccctggtggagcaggacctggaggtgccggtcctggaggcgctggacccggcggtgttggaccgggaggagctggaggacctggtggagccggcggtccatttggaccaggtggttccggaccaggtggcgctggtggcgctggtggtccatacggccctggcggagcttatggtccaggtggccctggtggtccaggtggtcctggtggcccaggctctggtggtccttacggaccaggtggagcttacggaccgggtggagcatatggtccaggaggagcatatggaccaggcggagccggaggtccatacggaccaggtggtccttacggccccggaggaccttacggtcccggtggtgcaggtggacccggaggcgccggtggtccatacggacccggtggtgctggtccgggtggatacggtccaggaggcgcaggtccaggaggttatggaccaggcggttctggacctggaggtgcaggacccggtggatatggacccggtggatccggacctggcggagccggacctggtggatatggacctggtggtgcaggtccaggcggttacggacctggtggcgctggacctggcggtgctggtcctggaggtgctggacctggcggatatggcccaggtggttctggtcctggaggacctggttcaggaggaccgggtggagccggaggatcaggcggtacaacagtcatcgaagatttagatattaccgtcaacggcccgggcggaccaatcacaatttctgaagagttgactgtaggaggtccaggtgcaggtggctcaggccctggtggagcaggacctggaggtgccggtcctggaggcgctggacccggcggtgttggaccgggaggagctggaggacctggtggagccggcggtccatttggaccaggtggttccggaccaggtggcgctggtggcgctggtggtccatacggccctggcggagcttatggtccaggtggccctggtggtccaggtggtcctggtggcccaggctctggtggtccttacggaccaggtggagcttacggaccgggtggagcatatggtccaggaggagcatatggaccaggcggagccggaggtccatacggaccaggtggtccttacggccccggaggaccttacggtcccggtggtgcaggtggacccggaggcgccggtggtccatacggacccggtggtgctggtccgggtggatacggtccaggaggcgcaggtccaggaggttatggaccaggcggttctggacctggaggtgcaggacccggtggatatggacccggtggatccggacctggcggagccggacctggtggatatggacctggtggtgcaggtccaggcggttacggacctggtggcgctggacctggcggtgctggtcctggaggtgctggacctggcggatatggcccaggtggttctggtcctggaggacctggttcaggaggaccgggtggagccggaggatcaggcggtacaacagtcatcgaagatttagatattaccgtcaacggcccgggcggaccaatcacaatttctgaagagttgactgtaggaggtccaggtgactacaaagatgacgacgataaagattacaaagacgatgacgataaggactataaagatgatgacgacaaataataa

SEQ ID NO: 1461 - DNA, 2460 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggttcacaagctgcaagtcagtccgctagtagctcggctagtcaggcttctgctagctcttttgcacaggcttcctccgcttcccttgcagccagttcatcttttagtagtgctttttcaagtgcaacatccttaagtgccttgggcaatgttgcttatcaactgggtttcgacgtcggtacaaacctaggtttgacaaatgcagccggtctagctgctgccttctctcaagctgcctcctcagtaggtgttggtggttcatctggagcttatgccaacgctttgtcgaatgccgcggcacaatttttgtcggctcaaggtatcttaaacacggtcaatgctggttctttagcctcttcttttgcatccgctctttcgtcagtcgcagcatctgctgctgcccaggccagttcacaatctcaagcagcttccagcgcgttctcacgagcagcaagtcaatcagcttcacagagtgctgccaggtctggagctcaatcttccagtagtacaacaactacttcctcctcaggttcacaagctgcaagtcagtccgctagtagctcggctagtcaggcttctgctagctcttttgcacaggcttcctccgcttcccttgcagccagttcatcttttagtagtgctttttcaagtgcaacatccttaagtgccttgggcaatgttgcttatcaactgggtttcgacgtcggtacaaacctaggtttgacaaatgcagccggtctagctgctgccttctctcaagctgcctcctcagtaggtgttggtggttcatctggagcttatgccaacgctttgtcgaatgccgcggcacaatttttgtcggctcaaggtatcttaaacacggtcaatgctggttctttagcctcttcttttgcatccgctctttcgtcagtcgcagcatctgctgctgcccaggccagttcacaatctcaagcagcttccagcgcgttctcacgagcagcaagtcaatcagcttcacagagtgctgccaggtctggagctcaatcttccagtagtacaacaactacttcctcctcaggttcacaagctgcaagtcagtccgctagtagctcggctagtcaggcttctgctagctcttttgcacaggcttcctccgcttcccttgcagccagttcatcttttagtagtgctttttcaagtgcaacatccttaagtgccttgggcaatgttgcttatcaactgggtttcgacgtcggtacaaacctaggtttgacaaatgcagccggtctagctgctgccttctctcaagctgcctcctcagtaggtgttggtggttcatctggagcttatgccaacgctttgtcgaatgccgcggcacaatttttgtcggctcaaggtatcttaaacacggtcaatgctggttctttagcctcttcttttgcatccgctctttcgtcagtcgcagcatctgctgctgcccaggccagttcacaatctcaagcagcttccagcgcgttctcacgagcagcaagtcaatcagcttcacagagtgctgccaggtctggagctcaatcttccagtagtacaacaactacttcctcctcaggttcacaagctgcaagtcagtccgctagtagctcggctagtcaggcttctgctagctcttttgcacaggcttcctccgcttcccttgcagccagttcatcttttagtagtgctttttcaagtgcaacatccttaagtgccttgggcaatgttgcttatcaactgggtttcgacgtcggtacaaacctaggtttgacaaatgcagccggtctagctgctgccttctctcaagctgcctcctcagtaggtgttggtggttcatctggagcttatgccaacgctttgtcgaatgccgcggcacaatttttgtcggctcaaggtatcttaaacacggtcaatgctggttctttagcctcttcttttgcatccgctctttcgtcagtcgcagcatctgctgctgcccaggccagttcacaatctcaagcagcttccagcgcgttctcacgagcagcaagtcaatcagcttcacagagtgctgccaggtctggagctcaatcttccagtagtacaacaactacttcctcctcaggtgactacaaagatgacgacgataaagattacaaagacgatgacgataaggactataaagatgatgacgacaaataataa

SEQ ID NO: 1462 - DNA, 3144 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtggatttggtccaggtggcgcaggccctggaggtgcaggccctggtggagcaggtcctggtggagctggccctggaggtgccggccctggaggagcaggtccaggtggcgctggacctggcggcgctggacctggtggagccggtggtgctggcggtgctggcggtgccggaggatcaggaggcgcgggaggcagcggtggaactactattatcgaagatttagacatcaccattgatggagctgatggccctatcacaatttccgaagaattgactatatccggtgcaggtggcagtggaccaggaggagctggtcctggtggagttggaccaggtggaagcggacctggtggtgttggcccaggtggtagtggtcctggaggagttggtccgggaggatccggacccggaggtgtcggtcctggtggagccggaggtccatacggaccgggtggatccggacctggcggcgccggtggagctggaggacctggtggtgcatatggaccaggtggatcctatggaccaggaggaagtggtggccccggtggagctggtggcccatacggaccaggaggcgaaggaccaggtggagcaggtggcccttacggaccaggtggtgccggaggtccttacggtcctggtggcgccggaggtccatatggtccaggcggtgaaggtggcccttatggtccaggtggatttggtccaggtggcgcaggccctggaggtgcaggccctggtggagcaggtcctggtggagctggccctggaggtgccggccctggaggagcaggtccaggtggcgctggacctggcggcgctggacctggtggagccggtggtgctggcggtgctggcggtgccggaggatcaggaggcgcgggaggcagcggtggaactactattatcgaagatttagacatcaccattgatggagctgatggccctatcacaatttccgaagaattgactatatccggtgcaggtggcagtggaccaggaggagctggtcctggtggagttggaccaggtggaagcggacctggtggtgttggcccaggtggtagtggtcctggaggagttggtccgggaggatccggacccggaggtgtcggtcctggtggagccggaggtccatacggaccgggtggatccggacctggcggcgccggtggagctggaggacctggtggtgcatatggaccaggtggatcctatggaccaggaggaagtggtggccccggtggagctggtggcccatacggaccaggaggcgaaggaccaggtggagcaggtggcccttacggaccaggtggtgccggaggtccttacggtcctggtggcgccggaggtccatatggtccaggcggtgaaggtggcccttatggtccaggtggatttggtccaggtggcgcaggccctggaggtgcaggccctggtggagcaggtcctggtggagctggccctggaggtgccggccctggaggagcaggtccaggtggcgctggacctggcggcgctggacctggtggagccggtggtgctggcggtgctggcggtgccggaggatcaggaggcgcgggaggcagcggtggaactactattatcgaagatttagacatcaccattgatggagctgatggccctatcacaatttccgaagaattgactatatccggtgcaggtggcagtggaccaggaggagctggtcctggtggagttggaccaggtggaagcggacctggtggtgttggcccaggtggtagtggtcctggaggagttggtccgggaggatccggacccggaggtgtcggtcctggtggagccggaggtccatacggaccgggtggatccggacctggcggcgccggtggagctggaggacctggtggtgcatatggaccaggtggatcctatggaccaggaggaagtggtggccccggtggagctggtggcccatacggaccaggaggcgaaggaccaggtggagcaggtggcccttacggaccaggtggtgccggaggtccttacggtcctggtggcgccggaggtccatatggtccaggcggtgaaggtggcccttatggtccaggtggatttggtccaggtggcgcaggccctggaggtgcaggccctggtggagcaggtcctggtggagctggccctggaggtgccggccctggaggagcaggtccaggtggcgctggacctggcggcgctggacctggtggagccggtggtgctggcggtgctggcggtgccggaggatcaggaggcgcgggaggcagcggtggaactactattatcgaagatttagacatcaccattgatggagctgatggccctatcacaatttccgaagaattgactatatccggtgcaggtggcagtggaccaggaggagctggtcctggtggagttggaccaggtggaagcggacctggtggtgttggcccaggtggtagtggtcctggaggagttggtccgggaggatccggacccggaggtgtcggtcctggtggagccggaggtccatacggaccgggtggatccggacctggcggcgccggtggagctggaggacctggtggtgcatatggaccaggtggatcctatggaccaggaggaagtggtggccccggtggagctggtggcccatacggaccaggaggcgaaggaccaggtggagcaggtggcccttacggaccaggtggtgccggaggtccttacggtcctggtggcgccggaggtccatatggtccaggcggtgaaggtggcccttatggtccaggtgactacaaagatgacgacgataaagattacaaagacgatgacgataaggactataaagatgatgacgacaaataataa

SEQ ID NO: 1463 - DNA, 2532 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtgaagctttctccgcttcatcggctagttcggctgttgtattcgaaagcgctggacctggtgaagaggccggttcttcaggtggaggagcttcagcggccgcatctgctgctgctgctgcaggagctggatctggtagaagaggtccgggtggagccagaagcagaggaggagctggtgctggtgcaggcgcgggatctggtgttggaggatatggatcgggcagcggagccggagctggcgctggtgccggtgccggtgccggaggtgaaggcggctttggtgagggtcaaggttacggcgctggtgcaggtgctggctttggttccggagctggagcgggagccggagcaggttccggtgcaggagctggagaaggagtaggtagcggtgcaggagcaggtgcgggtgctggctttggagtaggagccggtgccggagctggagcaggagctggttttggctcaggcgctggagctggatctggcgctggagcaggatacggtgctggccgtgctggaggaagaggacgtggaggcagaggaggtgaagctttctccgcttcatcggctagttcggctgttgtattcgaaagcgctggacctggtgaagaggccggttcttcaggtggaggagcttcagcggccgcatctgctgctgctgctgcaggagctggatctggtagaagaggtccgggtggagccagaagcagaggaggagctggtgctggtgcaggcgcgggatctggtgttggaggatatggatcgggcagcggagccggagctggcgctggtgccggtgccggtgccggaggtgaaggcggctttggtgagggtcaaggttacggcgctggtgcaggtgctggctttggttccggagctggagcgggagccggagcaggttccggtgcaggagctggagaaggagtaggtagcggtgcaggagcaggtgcgggtgctggctttggagtaggagccggtgccggagctggagcaggagctggttttggctcaggcgctggagctggatctggcgctggagcaggatacggtgctggccgtgctggaggaagaggacgtggaggcagaggaggtgaagctttctccgcttcatcggctagttcggctgttgtattcgaaagcgctggacctggtgaagaggccggttcttcaggtggaggagcttcagcggccgcatctgctgctgctgctgcaggagctggatctggtagaagaggtccgggtggagccagaagcagaggaggagctggtgctggtgcaggcgcgggatctggtgttggaggatatggatcgggcagcggagccggagctggcgctggtgccggtgccggtgccggaggtgaaggcggctttggtgagggtcaaggttacggcgctggtgcaggtgctggctttggttccggagctggagcgggagccggagcaggttccggtgcaggagctggagaaggagtaggtagcggtgcaggagcaggtgcgggtgctggctttggagtaggagccggtgccggagctggagcaggagctggttttggctcaggcgctggagctggatctggcgctggagcaggatacggtgctggccgtgctggaggaagaggacgtggaggcagaggaggtgaagctttctccgcttcatcggctagttcggctgttgtattcgaaagcgctggacctggtgaagaggccggttcttcaggtggaggagcttcagcggccgcatctgctgctgctgctgcaggagctggatctggtagaagaggtccgggtggagccagaagcagaggaggagctggtgctggtgcaggcgcgggatctggtgttggaggatatggatcgggcagcggagccggagctggcgctggtgccggtgccggtgccggaggtgaaggcggctttggtgagggtcaaggttacggcgctggtgcaggtgctggctttggttccggagctggagcgggagccggagcaggttccggtgcaggagctggagaaggagtaggtagcggtgcaggagcaggtgcgggtgctggctttggagtaggagccggtgccggagctggagcaggagctggttttggctcaggcgctggagctggatctggcgctggagcaggatacggtgctggccgtgctggaggaagaggacgtggaggcagaggaggtgactacaaagatgacgacgataaagattacaaagacgatgacgataaggactataaagatgatgacgacaaataataa

SEQ ID NO: 1464 - DNA, 3360 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtggttacggtcccggagctggacaacaaggacccggaggtgccggacagcaaggacctggttctcaaggacctggaggtcaaggaccatatggcccaggagccggacaacaaggtcctggtagccagggaccaggttcgggtggtcaacaaggtccgggaggtcaaggcccatacggtccatccgcagctgcagcagcagctgctgccggcggttatggtcctggtgccggccagcaaggaccaggttcacagggcccaggttctggaggtcaacaaggtcctggatctcaaggtcctggtagtggtggccaacaaggaccaggtggacaaggcccatatggcccttccgccgctgctgctgcagcagcggccggaggatatggtccaggagcaggtcagcagggtccaggttctcaaggaccaggctctggcggtcagcagggacctggtggtcaaggaccttatggaccaggagcagctgccgcagccgctgctgtcggaggttacggacctggagcaggtcaacagggtccaggatcgcagggaccaggatccggtggacagcaaggtccaggcggacaaggaccttacggaccatcagctgccgctgccgcggccgctgctggaggttatggaccaggcgcaggtcaacaaggacctggtagccaaggccctggtagtggtggacaacagggtccaggtggtcaaggtccatatggtccatccgcagcggctgctgctgctgccgcaggtggttacggtcccggagctggacaacaaggacccggaggtgccggacagcaaggacctggttctcaaggacctggaggtcaaggaccatatggcccaggagccggacaacaaggtcctggtagccagggaccaggttcgggtggtcaacaaggtccgggaggtcaaggcccatacggtccatccgcagctgcagcagcagctgctgccggcggttatggtcctggtgccggccagcaaggaccaggttcacagggcccaggttctggaggtcaacaaggtcctggatctcaaggtcctggtagtggtggccaacaaggaccaggtggacaaggcccatatggcccttccgccgctgctgctgcagcagcggccggaggatatggtccaggagcaggtcagcagggtccaggttctcaaggaccaggctctggcggtcagcagggacctggtggtcaaggaccttatggaccaggagcagctgccgcagccgctgctgtcggaggttacggacctggagcaggtcaacagggtccaggatcgcagggaccaggatccggtggacagcaaggtccaggcggacaaggaccttacggaccatcagctgccgctgccgcggccgctgctggaggttatggaccaggcgcaggtcaacaaggacctggtagccaaggccctggtagtggtggacaacagggtccaggtggtcaaggtccatatggtccatccgcagcggctgctgctgctgccgcaggtggttacggtcccggagctggacaacaaggacccggaggtgccggacagcaaggacctggttctcaaggacctggaggtcaaggaccatatggcccaggagccggacaacaaggtcctggtagccagggaccaggttcgggtggtcaacaaggtccgggaggtcaaggcccatacggtccatccgcagctgcagcagcagctgctgccggcggttatggtcctggtgccggccagcaaggaccaggttcacagggcccaggttctggaggtcaacaaggtcctggatctcaaggtcctggtagtggtggccaacaaggaccaggtggacaaggcccatatggcccttccgccgctgctgctgcagcagcggccggaggatatggtccaggagcaggtcagcagggtccaggttctcaaggaccaggctctggcggtcagcagggacctggtggtcaaggaccttatggaccaggagcagctgccgcagccgctgctgtcggaggttacggacctggagcaggtcaacagggtccaggatcgcagggaccaggatccggtggacagcaaggtccaggcggacaaggaccttacggaccatcagctgccgctgccgcggccgctgctggaggttatggaccaggcgcaggtcaacaaggacctggtagccaaggccctggtagtggtggacaacagggtccaggtggtcaaggtccatatggtccatccgcagcggctgctgctgctgccgcaggtggttacggtcccggagctggacaacaaggacccggaggtgccggacagcaaggacctggttctcaaggacctggaggtcaaggaccatatggcccaggagccggacaacaaggtcctggtagccagggaccaggttcgggtggtcaacaaggtccgggaggtcaaggcccatacggtccatccgcagctgcagcagcagctgctgccggcggttatggtcctggtgccggccagcaaggaccaggttcacagggcccaggttctggaggtcaacaaggtcctggatctcaaggtcctggtagtggtggccaacaaggaccaggtggacaaggcccatatggcccttccgccgctgctgctgcagcagcggccggaggatatggtccaggagcaggtcagcagggtccaggttctcaaggaccaggctctggcggtcagcagggacctggtggtcaaggaccttatggaccaggagcagctgccgcagccgctgctgtcggaggttacggacctggagcaggtcaacagggtccaggatcgcagggaccaggatccggtggacagcaaggtccaggcggacaaggaccttacggaccatcagctgccgctgccgcggccgctgctggaggttatggaccaggcgcaggtcaacaaggacctggtagccaaggccctggtagtggtggacaacagggtccaggtggtcaaggtccatatggtccatccgcagcggctgctgctgctgccgcaggtgactacaaagatgacgacgataaagattacaaagacgatgacgataaggactataaagatgatgacgacaaataataa

SEQ ID NO: 1465 - DNA, 2508 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtaacgttggttaccaattgggtttcaacgttgctaacaccctgggtataggaaacgctcctggtcttggtaatgctctctcccaagctgtatcgtcggtcggagtaggagcttcatcaagtgcctatgcaaatgcagtctcaaatgctgtcggacaattcttggcaggtcagggcgttcttaatgcaggtaatgccggatcgttggccagcagcttcgctaacgctctttccgcttcggccgcttctgtggcatcctctgccgctgcacaaagtgcctttcaatcacaagcggccgctagtgcatttagtcgagctgcttctcagagtgcgagtcagtcagctgcaagaagtggtgctcagtcatcttctactactacaactacgtctacttcaggctctcaagctgcctctcagtccgcatcgtctgctgccgctcaagcatcagcgagtagctttgcgcaagcatcatccgcgtcacttgctgcctcaagtgcttttagtagtgccttctcttccgctaattcattgtccgccttaggtaacgttggttaccaattgggtttcaacgttgctaacaccctgggtataggaaacgctcctggtcttggtaatgctctctcccaagctgtatcgtcggtcggagtaggagcttcatcaagtgcctatgcaaatgcagtctcaaatgctgtcggacaattcttggcaggtcagggcgttcttaatgcaggtaatgccggatcgttggccagcagcttcgctaacgctctttccgcttcggccgcttctgtggcatcctctgccgctgcacaaagtgcctttcaatcacaagcggccgctagtgcatttagtcgagctgcttctcagagtgcgagtcagtcagctgcaagaagtggtgctcagtcatcttctactactacaactacgtctacttcaggctctcaagctgcctctcagtccgcatcgtctgctgccgctcaagcatcagcgagtagctttgcgcaagcatcatccgcgtcacttgctgcctcaagtgcttttagtagtgccttctcttccgctaattcattgtccgccttaggtaacgttggttaccaattgggtttcaacgttgctaacaccctgggtataggaaacgctcctggtcttggtaatgctctctcccaagctgtatcgtcggtcggagtaggagcttcatcaagtgcctatgcaaatgcagtctcaaatgctgtcggacaattcttggcaggtcagggcgttcttaatgcaggtaatgccggatcgttggccagcagcttcgctaacgctctttccgcttcggccgcttctgtggcatcctctgccgctgcacaaagtgcctttcaatcacaagcggccgctagtgcatttagtcgagctgcttctcagagtgcgagtcagtcagctgcaagaagtggtgctcagtcatcttctactactacaactacgtctacttcaggctctcaagctgcctctcagtccgcatcgtctgctgccgctcaagcatcagcgagtagctttgcgcaagcatcatccgcgtcacttgctgcctcaagtgcttttagtagtgccttctcttccgctaattcattgtccgccttaggtaacgttggttaccaattgggtttcaacgttgctaacaccctgggtataggaaacgctcctggtcttggtaatgctctctcccaagctgtatcgtcggtcggagtaggagcttcatcaagtgcctatgcaaatgcagtctcaaatgctgtcggacaattcttggcaggtcagggcgttcttaatgcaggtaatgccggatcgttggccagcagcttcgctaacgctctttccgcttcggccgcttctgtggcatcctctgccgctgcacaaagtgcctttcaatcacaagcggccgctagtgcatttagtcgagctgcttctcagagtgcgagtcagtcagctgcaagaagtggtgctcagtcatcttctactactacaactacgtctacttcaggctctcaagctgcctctcagtccgcatcgtctgctgccgctcaagcatcagcgagtagctttgcgcaagcatcatccgcgtcacttgctgcctcaagtgcttttagtagtgccttctcttccgctaattcattgtccgccttaggtgactacaaagatgacgacgataaagattacaaagacgatgacgataaggactataaagatgatgacgacaaataataa

SEQ ID NO: 1466 - DNA, 2640 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtccaggaggtgccggtggtccatatggaccgggaggaccaggtggcgcgggtcctggtggctacggtccaggaggatatggaccaggtggtgctggtccaggtggagcaggaccgggaggctatggaccaggtggagccggtcctggaggatatggtccaggaggtgcaggtcctggcggtagcggtcctggtggcataggtccaggtggatccggaccaggaggatacggtccaggtggaattggcccgggaggaactggccccggtggtgctggacctggtggtgcaggtccaggtggtgctggcccatccggtgctggtcctggtggcgctggtccatcaggtgccggaagaggtggttccggtaggggttcggttggccgaggtggcgccggcagaggtggagccggtagaggaggtgcaggaggagcaggcggatccggaggcgcaggtggctctggcggtgccggcggatctggaggaacaacaatcatcgaggaccttgatattaccgttgatggagctaatggtccaattactattagtgaagaactaactataggtggtgcaggtccaggaggtgccggtggtccatatggaccgggaggaccaggtggcgcgggtcctggtggctacggtccaggaggatatggaccaggtggtgctggtccaggtggagcaggaccgggaggctatggaccaggtggagccggtcctggaggatatggtccaggaggtgcaggtcctggcggtagcggtcctggtggcataggtccaggtggatccggaccaggaggatacggtccaggtggaattggcccgggaggaactggccccggtggtgctggacctggtggtgcaggtccaggtggtgctggcccatccggtgctggtcctggtggcgctggtccatcaggtgccggaagaggtggttccggtaggggttcggttggccgaggtggcgccggcagaggtggagccggtagaggaggtgcaggaggagcaggcggatccggaggcgcaggtggctctggcggtgccggcggatctggaggaacaacaatcatcgaggaccttgatattaccgttgatggagctaatggtccaattactattagtgaagaactaactataggtggtgcaggtccaggaggtgccggtggtccatatggaccgggaggaccaggtggcgcgggtcctggtggctacggtccaggaggatatggaccaggtggtgctggtccaggtggagcaggaccgggaggctatggaccaggtggagccggtcctggaggatatggtccaggaggtgcaggtcctggcggtagcggtcctggtggcataggtccaggtggatccggaccaggaggatacggtccaggtggaattggcccgggaggaactggccccggtggtgctggacctggtggtgcaggtccaggtggtgctggcccatccggtgctggtcctggtggcgctggtccatcaggtgccggaagaggtggttccggtaggggttcggttggccgaggtggcgccggcagaggtggagccggtagaggaggtgcaggaggagcaggcggatccggaggcgcaggtggctctggcggtgccggcggatctggaggaacaacaatcatcgaggaccttgatattaccgttgatggagctaatggtccaattactattagtgaagaactaactataggtggtgcaggtccaggaggtgccggtggtccatatggaccgggaggaccaggtggcgcgggtcctggtggctacggtccaggaggatatggaccaggtggtgctggtccaggtggagcaggaccgggaggctatggaccaggtggagccggtcctggaggatatggtccaggaggtgcaggtcctggcggtagcggtcctggtggcataggtccaggtggatccggaccaggaggatacggtccaggtggaattggcccgggaggaactggccccggtggtgctggacctggtggtgcaggtccaggtggtgctggcccatccggtgctggtcctggtggcgctggtccatcaggtgccggaagaggtggttccggtaggggttcggttggccgaggtggcgccggcagaggtggagccggtagaggaggtgcaggaggagcaggcggatccggaggcgcaggtggctctggcggtgccggcggatctggaggaacaacaatcatcgaggaccttgatattaccgttgatggagctaatggtccaattactattagtgaagaactaactataggtggtgcaggtgactacaaagatgacgacgataaagattacaaagacgatgacgataaggactataaagatgatgacgacaaataataa

SEQ ID NO: 1467 - DNA, 3240 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtgcaggagctggtcagggcggacgaggcggctacggtcaaggaggatttggaggacaaggctccggtgcaggtgctggtgcaagcgcagctgcaggtgcaggagctggccaaggtggaagaggaggttacggacagggtggtttcggtggtcaaggttccggtgccggagctggagcttccgctgcagctggagctggtgctggtcaaggaggtagaggaggctacggacaaggcggttttggcggacaaggttcaggtgccggtgctggcgctagcgccgcagctgctgccggtgcaggacaaggtggaagaggcggttacggtcaaggtggacttggtggttcaggatctggtgctggagccggtgctggtgctgctgccgccgcagctgctggcgcaggaggttatggacaaggtggattaggtggttacggccaaggcgccggcgctggacagggcggcctcggaggttacggatcaggagcaggagccggtgcctcagccgctgcggctgcaggtgccggaggtgctggacaaggaggtttgggtggttatggtcagggcgcaggtgccggtcaaggtggtctgggtggttatggcagcggtgctggtgcaggagcagcagccgctgccgcagccggagccggaggctctggtcaaggaggactcggtggttatggctctggaggtggagctggaggagcaagtgccgctgctgcaggtgcaggagctggtcagggcggacgaggcggctacggtcaaggaggatttggaggacaaggctccggtgcaggtgctggtgcaagcgcagctgcaggtgcaggagctggccaaggtggaagaggaggttacggacagggtggtttcggtggtcaaggttccggtgccggagctggagcttccgctgcagctggagctggtgctggtcaaggaggtagaggaggctacggacaaggcggttttggcggacaaggttcaggtgccggtgctggcgctagcgccgcagctgctgccggtgcaggacaaggtggaagaggcggttacggtcaaggtggacttggtggttcaggatctggtgctggagccggtgctggtgctgctgccgccgcagctgctggcgcaggaggttatggacaaggtggattaggtggttacggccaaggcgccggcgctggacagggcggcctcggaggttacggatcaggagcaggagccggtgcctcagccgctgcggctgcaggtgccggaggtgctggacaaggaggtttgggtggttatggtcagggcgcaggtgccggtcaaggtggtctgggtggttatggcagcggtgctggtgcaggagcagcagccgctgccgcagccggagccggaggctctggtcaaggaggactcggtggttatggctctggaggtggagctggaggagcaagtgccgctgctgcaggtgcaggagctggtcagggcggacgaggcggctacggtcaaggaggatttggaggacaaggctccggtgcaggtgctggtgcaagcgcagctgcaggtgcaggagctggccaaggtggaagaggaggttacggacagggtggtttcggtggtcaaggttccggtgccggagctggagcttccgctgcagctggagctggtgctggtcaaggaggtagaggaggctacggacaaggcggttttggcggacaaggttcaggtgccggtgctggcgctagcgccgcagctgctgccggtgcaggacaaggtggaagaggcggttacggtcaaggtggacttggtggttcaggatctggtgctggagccggtgctggtgctgctgccgccgcagctgctggcgcaggaggttatggacaaggtggattaggtggttacggccaaggcgccggcgctggacagggcggcctcggaggttacggatcaggagcaggagccggtgcctcagccgctgcggctgcaggtgccggaggtgctggacaaggaggtttgggtggttatggtcagggcgcaggtgccggtcaaggtggtctgggtggttatggcagcggtgctggtgcaggagcagcagccgctgccgcagccggagccggaggctctggtcaaggaggactcggtggttatggctctggaggtggagctggaggagcaagtgccgctgctgcaggtgcaggagctggtcagggcggacgaggcggctacggtcaaggaggatttggaggacaaggctccggtgcaggtgctggtgcaagcgcagctgcaggtgcaggagctggccaaggtggaagaggaggttacggacagggtggtttcggtggtcaaggttccggtgccggagctggagcttccgctgcagctggagctggtgctggtcaaggaggtagaggaggctacggacaaggcggttttggcggacaaggttcaggtgccggtgctggcgctagcgccgcagctgctgccggtgcaggacaaggtggaagaggcggttacggtcaaggtggacttggtggttcaggatctggtgctggagccggtgctggtgctgctgccgccgcagctgctggcgcaggaggttatggacaaggtggattaggtggttacggccaaggcgccggcgctggacagggcggcctcggaggttacggatcaggagcaggagccggtgcctcagccgctgcggctgcaggtgccggaggtgctggacaaggaggtttgggtggttatggtcagggcgcaggtgccggtcaaggtggtctgggtggttatggcagcggtgctggtgcaggagcagcagccgctgccgcagccggagccggaggctctggtcaaggaggactcggtggttatggctctggaggtggagctggaggagcaagtgccgctgctgcaggtgactacaaagatgacgacgataaagattacaaagacgatgacgataaggactataaagatgatgacgacaaataataa

SEQ ID NO: 1468 - DNA, 3276 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtcctggtggatacggtggaccaggccagcctggaccgggacaaggtcaatatggccctggtccaggccagcagggaccaagacagggtggtcaacagggtccagctagtgccgctgccgctgccgcagccggtccaggcggctacggtggtcctggacaacagggaccacggcagggtcaacagcaaggtcctgcatccgcagctgctgccgctgctgccgcagctgcgggtcccagaggttacggtggaccgggtcagcaaggaccagtacaaggaggacaacaaggacctgcctctgccgcagctgccgcagctgctgctggtgttggaggatatggtggtccgggtcaacaaggaccaggacaaggccaatacggtcctggaactggtcaacaaggacagggaccatccggacagcagggtcctgctggtgccgccgctgcagcagctggtggtgctgctggtccaggtggttatggaggtccaggacaacaaggtccaggtcaaggacaatatggtccaggaacaggtcaacagggccaaggcccaagtggtcaacaaggtccggcaggagcagccgcggctgccgctgctgctgccggtccgggaggttatggtggcccgggacaacagggtccaggacagggacagtatggtcctggtgcaggtcagcagggtcaaggtcctggttctcagcaaggtccagcatcagcggctgcagcagcagcaggtcctggtggatacggtggaccaggccagcctggaccgggacaaggtcaatatggccctggtccaggccagcagggaccaagacagggtggtcaacagggtccagctagtgccgctgccgctgccgcagccggtccaggcggctacggtggtcctggacaacagggaccacggcagggtcaacagcaaggtcctgcatccgcagctgctgccgctgctgccgcagctgcgggtcccagaggttacggtggaccgggtcagcaaggaccagtacaaggaggacaacaaggacctgcctctgccgcagctgccgcagctgctgctggtgttggaggatatggtggtccgggtcaacaaggaccaggacaaggccaatacggtcctggaactggtcaacaaggacagggaccatccggacagcagggtcctgctggtgccgccgctgcagcagctggtggtgctgctggtccaggtggttatggaggtccaggacaacaaggtccaggtcaaggacaatatggtccaggaacaggtcaacagggccaaggcccaagtggtcaacaaggtccggcaggagcagccgcggctgccgctgctgctgccggtccgggaggttatggtggcccgggacaacagggtccaggacagggacagtatggtcctggtgcaggtcagcagggtcaaggtcctggttctcagcaaggtccagcatcagcggctgcagcagcagcaggtcctggtggatacggtggaccaggccagcctggaccgggacaaggtcaatatggccctggtccaggccagcagggaccaagacagggtggtcaacagggtccagctagtgccgctgccgctgccgcagccggtccaggcggctacggtggtcctggacaacagggaccacggcagggtcaacagcaaggtcctgcatccgcagctgctgccgctgctgccgcagctgcgggtcccagaggttacggtggaccgggtcagcaaggaccagtacaaggaggacaacaaggacctgcctctgccgcagctgccgcagctgctgctggtgttggaggatatggtggtccgggtcaacaaggaccaggacaaggccaatacggtcctggaactggtcaacaaggacagggaccatccggacagcagggtcctgctggtgccgccgctgcagcagctggtggtgctgctggtccaggtggttatggaggtccaggacaacaaggtccaggtcaaggacaatatggtccaggaacaggtcaacagggccaaggcccaagtggtcaacaaggtccggcaggagcagccgcggctgccgctgctgctgccggtccgggaggttatggtggcccgggacaacagggtccaggacagggacagtatggtcctggtgcaggtcagcagggtcaaggtcctggttctcagcaaggtccagcatcagcggctgcagcagcagcaggtcctggtggatacggtggaccaggccagcctggaccgggacaaggtcaatatggccctggtccaggccagcagggaccaagacagggtggtcaacagggtccagctagtgccgctgccgctgccgcagccggtccaggcggctacggtggtcctggacaacagggaccacggcagggtcaacagcaaggtcctgcatccgcagctgctgccgctgctgccgcagctgcgggtcccagaggttacggtggaccgggtcagcaaggaccagtacaaggaggacaacaaggacctgcctctgccgcagctgccgcagctgctgctggtgttggaggatatggtggtccgggtcaacaaggaccaggacaaggccaatacggtcctggaactggtcaacaaggacagggaccatccggacagcagggtcctgctggtgccgccgctgcagcagctggtggtgctgctggtccaggtggttatggaggtccaggacaacaaggtccaggtcaaggacaatatggtccaggaacaggtcaacagggccaaggcccaagtggtcaacaaggtccggcaggagcagccgcggctgccgctgctgctgccggtccgggaggttatggtggcccgggacaacagggtccaggacagggacagtatggtcctggtgcaggtcagcagggtcaaggtcctggttctcagcaaggtccagcatcagcggctgcagcagcagcaggtgactacaaagatgacgacgataaagattacaaagacgatgacgataaggactataaagatgatgacgacaaataataa

SEQ ID NO: 1469 - DNA, 58 bp, Artificial Sequence
  Description of Artificial Sequence: Synthetic oligonucleotide
cgcgccttagcgatggtctcaaggtggttacggtccaggcgctggtcaacaaggtcca

SEQ ID NO: 1470 - DNA, 50 bp, Artificial Sequence
  Description of Artificial Sequence: Synthetic oligonucleotide
ggaagtggtggtcaacaaggacctggcggtcaaggaccctacggtagtgg

SEQ ID NO: 1471 - DNA, 50 bp, Artificial Sequence
  Description of Artificial Sequence: Synthetic oligonucleotide
ccaacaaggtccaggtggagcaggacagcagggtccgggaggccaaggac

SEQ ID NO: 1472 - DNA, 53 bp, Artificial Sequence
  Description of Artificial Sequence: Synthetic oligonucleotide
cttacggaccaggtgctgctgctgccgccgctgccgctgccggaggttacggt

SEQ ID NO: 1473 - DNA, 47 bp, Artificial Sequence
  Description of Artificial Sequence: Synthetic oligonucleotide
ccaggagccggacaacagggtccaggtggagctggacaacaaggtcc

SEQ ID NO: 1474 - DNA, 50 bp, Artificial Sequence
  Description of Artificial Sequence: Synthetic oligonucleotide
aggatcacaaggtcctggtggacaaggtccatacggtcctggtgctggtc

SEQ ID NO: 1475 - DNA, 51 bp, Artificial Sequence
  Description of Artificial Sequence: Synthetic oligonucleotide
aacagggaccaggtagtcaaggacctggttcaggtggtcagcagggtccag

SEQ ID NO: 1476 - DNA, 48 bp, Artificial Sequence
  Description of Artificial Sequence: Synthetic oligonucleotide
gaggacagggtccttacggcccttctgccgctgcagcagcagccgctg

SEQ ID NO: 1477 - DNA, 49 bp, Artificial Sequence
  Description of Artificial Sequence: Synthetic oligonucleotide
ccgcaggaggatacggacctggtgctggacaacgatctcaaggaccagg

SEQ ID NO: 1478 - DNA, 49 bp, Artificial Sequence
  Description of Artificial Sequence: Synthetic oligonucleotide
aggacaaggtccttatggacctggcgctggccaacaaggacctggttct

SEQ ID NO: 1479 - DNA, 49 bp, Artificial Sequence
  Description of Artificial Sequence: Synthetic oligonucleotide
cagggtccaggttcaggaggccaacaaggcccaggaggtcaaggaccat

SEQ ID NO: 1480 - DNA, 60 bp, Artificial Sequence
  Description of Artificial Sequence: Synthetic oligonucleotide
acggaccatccgctgcggcagctgcagctgctgcaggtacgtcttcatcgctatcctgca

SEQ ID NO: 1481 - DNA, 60 bp, Artificial Sequence
  Description of Artificial Sequence: Synthetic oligonucleotide
acttcctggaccttgttgaccagcgcctggaccgtaaccaccttgagaccatcgctaagg

SEQ ID NO: 1482 - DNA, 50 bp, Artificial Sequence
  Description of Artificial Sequence: Synthetic oligonucleotide
tgttggccactaccgtagggtccttgaccgccaggtccttgttgaccacc

SEQ ID NO: 1483 - DNA, 50 bp, Artificial Sequence
  Description of Artificial Sequence: Synthetic oligonucleotide
cgtaaggtccttggcctcccggaccctgctgtcctgctccacctggacct

SEQ ID NO: 1484 - DNA, 53 bp, Artificial Sequence
  Description of Artificial Sequence: Synthetic oligonucleotide
tcctggaccgtaacctccggcagcggcagcggcggcagcagcagcacctggtc

SEQ ID NO: 1485 - DNA, 47 bp, Artificial Sequence
  Description of Artificial Sequence: Synthetic oligonucleotide
gatcctggaccttgttgtccagctccacctggaccctgttgtccggc

SEQ ID NO: 1486 - DNA, 50 bp, Artificial Sequence
  Description of Artificial Sequence: Synthetic oligonucleotide
cctgttgaccagcaccaggaccgtatggaccttgtccaccaggaccttgt

SEQ ID NO: 1487 - DNA, 51 bp, Artificial Sequence
  Description of Artificial Sequence: Synthetic oligonucleotide
gtcctcctggaccctgctgaccacctgaaccaggtccttgactacctggtc

SEQ ID NO: 1488 - DNA, 48 bp, Artificial Sequence
  Description of Artificial Sequence: Synthetic oligonucleotide
ctgcggcagcggctgctgctgcagcggcagaagggccgtaaggaccct

SEQ ID NO: 1489 - DNA, 49 bp, Artificial Sequence
  Description of Artificial Sequence: Synthetic oligonucleotide
tgtcctcctggtccttgagatcgttgtccagcaccaggtccgtatcctc

SEQ ID NO: 1490 - DNA, 49 bp, Artificial Sequence
  Description of Artificial Sequence: Synthetic oligonucleotide
accctgagaaccaggtccttgttggccagcgccaggtccataaggacct

SEQ ID NO: 1491 - DNA, 49 bp, Artificial Sequence
  Description of Artificial Sequence: Synthetic oligonucleotide
gtccgtatggtccttgacctcctgggccttgttggcctcctgaacctgg

SEQ ID NO: 1492 - DNA, 50 bp, Artificial Sequence
  Description of Artificial Sequence: Synthetic oligonucleotide
ggatagcgatgaagacgtacctgcagcagctgcagctgccgcagcggatg

SEQ ID NO: 1493 - DNA, 58 bp, Artificial Sequence
  Description of Artificial Sequence: Synthetic oligonucleotide
cgcgccttagcgatggtctcaaggtggatatggcccaggagccggacaacagggtcct

SEQ ID NO: 1494 - DNA, 52 bp, Artificial Sequence
  Description of Artificial Sequence: Synthetic oligonucleotide
ggttcacaaggtccaggatctggtggtcaacagggaccaggcggccagggac

SEQ ID NO: 1495 - DNA, 51 bp, Artificial Sequence
  Description of Artificial Sequence: Synthetic oligonucleotide
cttatggtccaggagccgctgcagcagcagcagctgttggaggttacggcc

SEQ ID NO: 1496 - DNA, 51 bp, Artificial Sequence
  Description of Artificial Sequence: Synthetic oligonucleotide
ctggtgccggtcaacaaggcccaggatctcagggtcctggatctggaggac

SEQ ID NO: 1497 - DNA, 52 bp, Artificial Sequence
  Description of Artificial Sequence: Synthetic oligonucleotide
aacaaggtcctggaggtcagggtccatacggaccttcagcagcagctgctgc

SEQ ID NO: 1498 - DNA, 50 bp, Artificial Sequence
  Description of Artificial Sequence: Synthetic oligonucleotide
tgcagccgctggtggttatggacctggtgctggtcaacaaggaccgggtt

SEQ ID NO: 1499 - DNA, 51 bp, Artificial Sequence
  Description of Artificial Sequence: Synthetic oligonucleotide
ctcagggtccgggttcaggaggtcagcagggccctggtggacaaggacctt

SEQ ID NO: 1500 - DNA, 60 bp, Artificial Sequence
  Description of Artificial Sequence: Synthetic oligonucleotide
atggacctagtgcggctgcagcagctgccgccgcaggtacgtcttcatcgctatcctgca

SEQ ID NO: 1501 - DNA, 60 bp, Artificial Sequence
  Description of Artificial Sequence: Synthetic oligonucleotide
tgaaccaggaccctgttgtccggctcctgggccatatccaccttgagaccatcgctaagg

SEQ ID NO: 1502 - DNA, 52 bp, Artificial Sequence
  Description of Artificial Sequence: Synthetic oligonucleotide
cataaggtccctggccgcctggtccctgttgaccaccagatcctggaccttg

SEQ ID NO: 1503 - DNA, 51 bp, Artificial Sequence
  Description of Artificial Sequence: Synthetic oligonucleotide
caccagggccgtaacctccaacagctgctgctgctgcagcggctcctggac

SEQ ID NO: 1504 - DNA, 51 bp, Artificial Sequence
  Description of Artificial Sequence: Synthetic oligonucleotide
cttgttgtcctccagatccaggaccctgagatcctgggccttgttgaccgg

SEQ ID NO: 1505 - DNA, 52 bp, Artificial Sequence
  Description of Artificial Sequence: Synthetic oligonucleotide
gctgcagcagcagctgctgctgaaggtccgtatggaccctgacctccaggac

SEQ ID NO: 1506 - DNA, 50 bp, Artificial Sequence
  Description of Artificial Sequence: Synthetic oligonucleotide
cctgagaacccggtccttgttgaccagcaccaggtccataaccaccagcg

SEQ ID NO: 1507 - DNA, 51 bp, Artificial Sequence
  Description of Artificial Sequence: Synthetic oligonucleotide
gtccataaggtccttgtccaccagggccctgctgacctcctgaacccggac

SEQ ID NO: 1508 - DNA, 50 bp, Artificial Sequence
  Description of Artificial Sequence: Synthetic oligonucleotide
ggatagcgatgaagacgtacctgcggcggcagctgctgcagccgcactag

SEQ ID NO: 1509 - protein, 892 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGAGYTGPSGPSTGPSGYPGPLGGGAPFGQSGFGGSDGPQGGFGATGGASAGLISRVANALANTSTLRTVLRTGVSQQIASSVVQRAAQSLASTLGVDGNNLARFAVQAVSRLPAGSDTSAYAQAFSSALFNAGVLNASNIDTLGSRVLSALLNGVSSAAQGLGINVDSGSVQSDISSSSSFLSTSSSSASYSQASASSTSGAGYTGPSGPSTGPSGYPGPLGGGAPFGQSGFGGSDGPQGGFGATGGASAGLISRVANALANTSTLRTVLRTGVSQQIASSVVQRAAQSLASTLGVDGNNLARFAVQAVSRLPAGSDTSAYAQAFSSALFNAGVLNASNIDTLGSRVLSALLNGVSSAAQGLGINVDSGSVQSDISSSSSFLSTSSSSASYSQASASSTSGFTGASYPGPQVSQPAPFGVGPQPGGALPGFGQVSGAQSALISRIANALGNTATMRAVLRSGVSQQIVSNVVQGAVQALSSSLGIDGNNLARIASQTILRVPAGSDTSAYAQAFSTALFNSGVLNASNVNTLGSQVVSTLLRGISSTAQGLGLNVDAGSVQSDISSSSSFLSTSSSSTSSSQTTAASTSGFTGASYPGPQVSQPAPFGVGPQPGGALPGFGQVSGAQSALISRIANALGNTATMRAVLRSGVSQQIVSNVVQGAVQALSSSLGIDGNNLARIASQTILRVPAGSDTSAYAQAFSTALFNSGVLNASNVNTLGSQVVSTLLRGISSTAQGLGLNVDAGSVQSDISSSSSFLSTSSSSTSSSQTTAASTSGDYKDDDDKDYKDDDDKDYKDDDDK

SEQ ID NO: 1510 - DNA, 2976 bp, Artificial Sequence
  Description of Artificial Sequence: Synthetic polynucleotide
gaaacgatgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtgctggagccggcgctggagctggcgccggagcaggctattcggccggcgctggttacggtattggagctggagccggagtgggcgctggtgctggtgcaggcgcaggtgccggatctggtaccggtactggagccggatatggttacggatcttcaacccaatctagctccaccatttacgctgctacctaccagggtggttatggacgagttgcaggcctgggtgccggagctggtgcaggtgcaggtgcaggaggaggtgcaggtgccggagcaggtacaggtgccggagctggagcaggaataggtgctggttatggtgctggcgcgggttatggagccggagctggaaccggctccggagcaggtgccggtgcaggaggaggcgcagcagctggtgctggttcgggtgttggtgcaggctacggtgcaggagctggctatggagccggagccggagccggtggtggagcaggtgcaggagccggaagcggtgcttcagcaggtgctggagccggcgctggagctggcgccggagcaggctattcggccggcgctggttacggtattggagctggagccggagtgggcgctggtgctggtgcaggcgcaggtgccggatctggtaccggtactggagccggatatggttacggatcttcaacccaatctagctccaccatttacgctgctacctaccagggtggttatggacgagttgcaggcctgggtgccggagctggtgcaggtgcaggtgcaggaggaggtgcaggtgccggagcaggtacaggtgccggagctggagcaggaataggtgctggttatggtgctggcgcgggttatggagccggagctggaaccggctccggagcaggtgccggtgcaggaggaggcgcagcagctggtgctggttcgggtgttggtgcaggctacggtgcaggagctggctatggagccggagccggagccggtggtggagcaggtgcaggagccggaagcggtgcttcagcaggtggcgcaccaggtggtggaccaggaggtgccggtccgggcggtgccggatttggacccggaggaggagccggattcggccctggaggaggtgccggtttcggcccaggaggtgctgccggaggaccaggtggtcctggtggacctggaggtccaggtggagctggtggatacggtccaggaggagctggaggatacggaccaggaggtgtcggtcctggtggagctggaggatatggacctggaggtgctggaggttacggtccaggaggttccggtccaggtggtgccggaccgggtggtgccggtggcgagggtccggttactgtagacgttgatgttactgttggacctgaaggagtgggaggaggaccaggtggcgccggtccaggaggtgcaggattcggcccaggtggcggagcgggtttcggtccaggtggcgcccctggagccccaggaggaccaggaggtcctggaggaccgggtggtccaggaggtccaggaggtgtaggaccgggtggagctggaggttacggccctggtggtgctggtggagtaggaccggctggtactggaggattcggtcctggaggagccggtggttttggacctggtggagcaggaggttttggtcctggaggagcaggtggattcggaccaggaggtgctggaggatatggtccaggtggtgttggtcctggtggtgcaggaggttttggacctggaggagttggtccaggaggatcaggacccggaggagctggtggtgaaggaccagtaacagtagatgtagacgtctcagtaggtggcgcaccaggtggtggaccaggaggtgccggtccgggcggtgccggatttggacccggaggaggagccggattcggccctggaggaggtgccggtttcggcccaggaggtgctgccggaggaccaggtggtcctggtggacctggaggtccaggtggagctggtggatacggtccaggaggagctggaggatacggaccaggaggtgtcggtcctggtggagctggaggatatggacctggaggtgctggaggttacggtccaggaggttccggtccaggtggtgccggaccgggtggtgccggtggcgagggtccggttactgtagacgttgatgttactgttggacctgaaggagtgggaggaggaccaggtggcgccggtccaggaggtgcaggattcggcccaggtggcggagcgggtttcggtccaggtggcgcccctggagccccaggaggaccaggaggtcctggaggaccgggtggtccaggaggtccaggaggtgtaggaccgggtggagctggaggttacggccctggtggtgctggtggagtaggaccggctggtactggaggattcggtcctggaggagccggtggttttggacctggtggagcaggaggttttggtcctggaggagcaggtggattcggaccaggaggtgctggaggatatggtccaggtggtgttggtcctggtggtgcaggaggttttggacctggaggagttggtccaggaggatcaggacccggaggagctggtggtgaaggaccagtaacagtagatgtagacgtctcagtaggtgactacaaagatgacgacgataaagattacaaagacgatgacgataaggactataaagatgatgacgacaaataataa

SEQ ID NO: 1511 - protein, 988 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGAGAGAGAGAGAGYSAGAGYGIGAGAGVGAGAGAGAGAGSGTGTGAGYGYGSSTQSSSTIYAATYQGGYGRVAGLGAGAGAGAGAGGGAGAGAGTGAGAGAGIGAGYGAGAGYGAGAGTGSGAGAGAGGGAAAGAGSGVGAGYGAGAGYGAGAGAGGGAGAGAGSGASAGAGAGAGAGAGAGYSAGAGYGIGAGAGVGAGAGAGAGAGSGTGTGAGYGYGSSTQSSSTIYAATYQGGYGRVAGLGAGAGAGAGAGGGAGAGAGTGAGAGAGIGAGYGAGAGYGAGAGTGSGAGAGAGGGAAAGAGSGVGAGYGAGAGYGAGAGAGGGAGAGAGSGASAGGAPGGGPGGAGPGGAGFGPGGGAGFGPGGGAGFGPGGAAGGPGGPGGPGGPGGAGGYGPGGAGGYGPGGVGPGGAGGYGPGGAGGYGPGGSGPGGAGPGGAGGEGPVTVDVDVTVGPEGVGGGPGGAGPGGAGFGPGGGAGFGPGGAPGAPGGPGGPGGPGGPGGPGGVGPGGAGGYGPGGAGGVGPAGTGGFGPGGAGGFGPGGAGGFGPGGAGGFGPGGAGGYGPGGVGPGGAGGFGPGGVGPGGSGPGGAGGEGPVTVDVDVSVGGAPGGGPGGAGPGGAGFGPGGGAGFGPGGGAGFGPGGAAGGPGGPGGPGGPGGAGGYGPGGAGGYGPGGVGPGGAGGYGPGGAGGYGPGGSGPGGAGPGGAGGEGPVTVDVDVTVGPEGVGGGPGGAGPGGAGFGPGGGAGFGPGGAPGAPGGPGGPGGPGGPGGPGGVGPGGAGGYGPGGAGGVGPAGTGGFGPGGAGGFGPGGAGGFGPGGAGGFGPGGAGGYGPGGVGPGGAGGFGPGGVGPGGSGPGGAGGEGPVTVDVDVSVGDYKDDDDKDYKDDDDKDYKDDDDK

SEQ ID NO: 1512 - DNA, 5938 bp, Artificial Sequence
  Description of Artificial Sequence: Synthetic polynucleotide
actagtgttcttttctgtatgaaaatagttatttcgagtctctacggaaatagcgagagatgatatacctaaatagagataaaatcatctcaaaaaaatgggtctactaaaatattattccatctattacaataaattcacagaatagtcttttaagtaagtctactctgaacttaagcaaaaggagagggacgcgtgtgagaagcaaaaaattgtggatcagcttgttgtttgcgttaacgttaatctttacgatggcgttcagcaacatgtctgcgcaggctgcggccggtgcacatatggagctcggtaccctcgagggatccgaattcaagcttgtcgacctgcagtctagacatcaccatcatcaccactaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctatttcactttttgcattctacaaactgcataactattatgtaaatcgctcctttttaggtggcacaaatgtgaggcattttcgctctttccggcaaccacttccaagtaaagtataacacactatactttatattcataaagtgtgtgctctgcgaggctgtcggcagtgccgaccaaaaccataaaacctttaagacctttcttttttttacgagaaaaaagaaacaaaaaaacctgccctctgccacctcagcaaaggggggttttgctctcgtgctcgtttaaaaatcagcaagggacaggtagtattttttgagaagatcactcaaaaaatctccacctttaaacccttgccaatttttattttgtccgttttgtctagcttaccgaaagccagactcagcaagaataaaatttttattgtctttcggttttctagtgtaacggacaaaaccactcaaaataaaaaagatacaagagaggtctctcgtatcttttattcagcaatcgcgcccgattgctgaacagattaataatagattttagctttttatttgttgaaaaaagctaatcaaattgttgtcgggatcaattactgcaaagtctcgttcatcccaccactgatcttttaatgatgtattggggtgcaaaatgcccaaaggcttaatatgttgatataattcatcaattccctctacttcaatgcggcaactagcagtaccagcaataaacgactccgcacctgtacaaaccggtgaatcattactacgagagcgccagccttcatcacttgcctcccatagatgaatccgaacctcattacacattagaactgcgaatccatcttcatggtgaaccaaagtgaaacctagtttatcgcaataaaaacctatactctttttaatatccccgactggcaatgccgggatagactgtaacattctcacgcataaaatcccctttcattttctaatgtaaatctattaccttattattaattcaattcgctcataattaatcctttttcttattacgcaaaatggcccgatttaagcacaccctttattccgttaatgcgccatgacagccatgataattactaatactaggagaagttaataaatacgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacagtaaccaacatgattaacaattattagaggtcatcgttcaaaatggtatgcgttttgacacatccactatatatccgtgtcgttctgtccactcctgaatcccattccagaaattctctagcgattccagaagtttctcagagtcggaaagttgaccagacattacgaactggcacagatggtcataacctgaaggaagatctgattgcttaactgcttcagttaagaccgaagcgctcgtcgtataacagatgcgatgatgcagaccaatcaacatggcacctgccattgctacctgtacagtcaaggatggtagaaatgttgtcggtccttgcacacgaatattacgccatttgcctgcatattcaaacagctcttctacgataagggcacaaatcgcatcgtggaacgtttgggcttctaccgatttagcagtttgatacactttctctaagtatccacctgaatcataaatcggcaaaatagagaaaaattgaccatgtgtaagcggccaatctgattccacctgagatgcataatctagtagaatctcttcgctatcaaaattcacttccaccttccactcaccggttgtccattcatggctgaactctgcttcctctgttgacatgacacacatcatctcaatatccgaatagggcccatcagtctgacgaccaagagagccataaacaccaatagccttaacatcatccccatatttatccaatattcgttccttaatttcatgaacaatcttcattctttcttctctagtcattattattggtccattcactattctcattcccttttcagataattttagatttgcttttctaaataagaatatttggagagcaccgttcttattcagctattaataactcgtcttcctaagcatccttcaatccttttaataacaattatagcatctaatcttcaacaaactggcccgtttgttgaactactctttaataaaataatttttccgttcccaattccacattgcaataatagaaaatccatcttcatcggctttttcgtcatcatctgtatgaatcaaatcgccttcttctgtgtcatcaaggtttaattttttatgtatttcttttaacaaaccaccataggagattaaccttttacggtgtaaaccttcctccaaatcagacaaacgtttcaaattcttttcttcatcatcggtcataaaatccgtatcctttacaggatattttgcagtttcgtcaattgccgattgtatatccgatttatatttatttttcggtcgaatcatttgaacttttacatttggatcatagtctaatttcattgcctttttccaaaattgaatccattgtttttgattcacgtagttttctgtattcttaaaataagttggttccacacataccaatacatgcatgtgctgattataagaattatctttattatttattgtcacttccgttgcacgcataaaaccaacaagatttttattaatttttttatattgcatcattcggcgaaatccttgagccatatctgacaaactcttatttaattcttcgccatcataaacatttttaactgttaatgtgagaaacaaccaacgaactgttggcttttgtttaataacttcagcaacaaccttttgtgactgaatgccatgtttcattgctctcctccagttgcacattggacaaagcctggatttacaaaaccacactcgatacaactttctttcgcctgtttcacgattttgtttatactctaatatttcagcacaatcttttactctttcagcctttttaaattcaagaatatgcagaagttcaaagtaatcaacattagcgattttcttttctctccatggtctcacttttccactttttgtcttgtccactaaaacccttgatttttcatctgaataaatgctactattaggacacataatattaaaagaaacccccatctatttagttatttgtttagtcacttataactttaacagatggggtttttctgtgcaaccaattttaagggttttcaatactttaaaacacatacataccaacacttcaacgcacctttcagcaactaaaataaaaatgacgttatttctatatgtatcaagataagaaagaacaagttcaaaaccatcaaaaaaagacaccttttcaggtgctttttttattttataaactcattccctgatctcgacttcgttctttttttacctctcggttatgagttagttcaaattcgttctttttaggttctaaatcgtgtttttcttggaattgtgctgttttatcctttaccttgtctacaaaccccttaaaaacgtttttaaaggcttttaagccgtctgtacgttcctaa

SEQ ID NO: 1513 - DNA, 8759 bp, Artificial Sequence
  Description of Artificial Sequence: Synthetic polynucleotide
actagtgttcttttctgtatgaaaatagttatttcgagtctctacggaaatagcgagagatgatatacctaaatagagataaaatcatctcaaaaaaatgggtctactaaaatattattccatctattacaataaattcacagaatagtcttttaagtaagtctactctgaacttaagcaaaaggagagggacgcgtgtgagaagcaaaaaattgtggatcagcttgttgtttgcgttaacgttaatctttacgatggcgttcagcaacatgtctgcgcaggctgcggccgggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggaccaggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgcaggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaaggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgcaggtggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggaccaggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgcaggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaaggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgcaggtggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggaccaggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgcaggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaaggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgcagactacaaagatgacgacgataaagattacaaagacgatgacgataaggactataaagatgatgacgacaaataatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctatttcactttttgcattctacaaactgcataactattatgtaaatcgctcctttttaggtggcacaaatgtgaggcattttcgctctttccggcaaccacttccaagtaaagtataacacactatactttatattcataaagtgtgtgctctgcgaggctgtcggcagtgccgaccaaaaccataaaacctttaagacctttcttttttttacgagaaaaaagaaacaaaaaaacctgccctctgccacctcagcaaaggggggttttgctctcgtgctcgtttaaaaatcagcaagggacaggtagtattttttgagaagatcactcaaaaaatctccacctttaaacccttgccaatttttattttgtccgttttgtctagcttaccgaaagccagactcagcaagaataaaatttttattgtctttcggttttctagtgtaacggacaaaaccactcaaaataaaaaagatacaagagaggtctctcgtatcttttattcagcaatcgcgcccgattgctgaacagattaataatagattttagctttttatttgttgaaaaaagctaatcaaattgttgtcgggatcaattactgcaaagtctcgttcatcccaccactgatcttttaatgatgtattggggtgcaaaatgcccaaaggcttaatatgttgatataattcatcaattccctctacttcaatgcggcaactagcagtaccagcaataaacgactccgcacctgtacaaaccggtgaatcattactacgagagcgccagccttcatcacttgcctcccatagatgaatccgaacctcattacacattagaactgcgaatccatcttcatggtgaaccaaagtgaaacctagtttatcgcaataaaaacctatactctttttaatatccccgactggcaatgccgggatagactgtaacattctcacgcataaaatcccctttcattttctaatgtaaatctattaccttattattaattcaattcgctcataattaatcctttttcttattacgcaaaatggcccgatttaagcacaccctttattccgttaatgcgccatgacagccatgataattactaatactaggagaagttaataaatacgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacagtaaccaacatgattaacaattattagaggtcatcgttcaaaatggtatgcgttttgacacatccactatatatccgtgtcgttctgtccactcctgaatcccattccagaaattctctagcgattccagaagtttctcagagtcggaaagttgaccagacattacgaactggcacagatggtcataacctgaaggaagatctgattgcttaactgcttcagttaagaccgaagcgctcgtcgtataacagatgcgatgatgcagaccaatcaacatggcacctgccattgctacctgtacagtcaaggatggtagaaatgttgtcggtccttgcacacgaatattacgccatttgcctgcatattcaaacagctcttctacgataagggcacaaatcgcatcgtggaacgtttgggcttctaccgatttagcagtttgatacactttctctaagtatccacctgaatcataaatcggcaaaatagagaaaaattgaccatgtgtaagcggccaatctgattccacctgagatgcataatctagtagaatctcttcgctatcaaaattcacttccaccttccactcaccggttgtccattcatggctgaactctgcttcctctgttgacatgacacacatcatctcaatatccgaatagggcccatcagtctgacgaccaagagagccataaacaccaatagccttaacatcatccccatatttatccaatattcgttccttaatttcatgaacaatcttcattctttcttctctagtcattattattggtccattcactattctcattcccttttcagataattttagatttgcttttctaaataagaatatttggagagcaccgttcttattcagctattaataactcgtcttcctaagcatccttcaatccttttaataacaattatagcatctaatcttcaacaaactggcccgtttgttgaactactctttaataaaataatttttccgttcccaattccacattgcaataatagaaaatccatcttcatcggctttttcgtcatcatctgtatgaatcaaatcgccttcttctgtgtcatcaaggtttaattttttatgtatttcttttaacaaaccaccataggagattaaccttttacggtgtaaaccttcctccaaatcagacaaacgtttcaaattcttttcttcatcatcggtcataaaatccgtatcctttacaggatattttgcagtttcgtcaattgccgattgtatatccgatttatatttatttttcggtcgaatcatttgaacttttacatttggatcatagtctaatttcattgcctttttccaaaattgaatccattgtttttgattcacgtagttttctgtattcttaaaataagttggttccacacataccaatacatgcatgtgctgattataagaattatctttattatttattgtcacttccgttgcacgcataaaaccaacaagatttttattaatttttttatattgcatcattcggcgaaatccttgagccatatctgacaaactcttatttaattcttcgccatcataaacatttttaactgttaatgtgagaaacaaccaacgaactgttggcttttgtttaataacttcagcaacaaccttttgtgactgaatgccatgtttcattgctctcctccagttgcacattggacaaagcctggatttacaaaaccacactcgatacaactttctttcgcctgtttcacgattttgtttatactctaatatttcagcacaatcttttactctttcagcctttttaaattcaagaatatgcagaagttcaaagtaatcaacattagcgattttcttttctctccatggtctcacttttccactttttgtcttgtccactaaaacccttgatttttcatctgaataaatgctactattaggacacataatattaaaagaaacccccatctatttagttatttgtttagtcacttataactttaacagatggggtttttctgtgcaaccaattttaagggttttcaatactttaaaacacatacataccaacacttcaacgcacctttcagcaactaaaataaaaatgacgttatttctatatgtatcaagataagaaagaacaagttcaaaaccatcaaaaaaagacaccttttcaggtgctttttttattttataaactcattccctgatctcgacttcgttctttttttacctctcggttatgagttagttcaaattcgttctttttaggttctaaatcgtgtttttcttggaattgtgctgttttatcctttaccttgtctacaaaccccttaaaaacgtttttaaaggcttttaagccgtctgtacgttcctaa

SEQ ID NO: 1514 - DNA, 4394 bp, Artificial Sequence
  Description of Artificial Sequence: Synthetic polynucleotide
gcgatcgcggtctcatctagagacggcggggagctcgctgaggcttgacatgattggtgcgtatgtttgtatgaagctacaggactgatttggcgggctatgagggcgggggaagctctggaagggccgcgatggggcgcgcggcgtccagaaggcgccatacggcccgctggcggcacccatccggtataaaagcccgcgaccccgaacggtgacctccactttcagcgacaaacgagcacttatacatacgcgactattctgccgctatacataaccactcaaccttcattgtcatggccaggtgagtcgacgagcaagcccggcggatcaggcagcgtgcttgcagatttgacttgcaacgcccgcattgtgtcgacgaaggcttttggctcctctgtcgctgtctcaagcagcatctaaccctgcgtcgccgtttccatttgcaccatcgccaagaccaatcgaattcctccagccatcccatatcccatggaagcttgattgtcatcgccaggtgagtcgacgagcaagcccggcggatcaggcagcgtgcttgcagatttgacttgcaacgcccgcattgtgtcgacgaaggcttttggctcctctgtcgctgtctcaagcagcatctaaccctgcgtcgccgtttccatttgcaccatggccaagaccaatcgaattcctgcacccatccgatatcccatcgaaccttgattgtcatggccaggtgagtcgacgagcaagcccggcggatcaggcagcgtgcttgcagatttgacttgcaacgcccgcattgtgtcgacgaaggcttttggctcctctgtcgctgtctcaagcagcatctaaccctgcgtcgccgtttccatttgcaggatggccaagaccaatcgaattcctgcaggcatcccatatcccatggaagcttcattgtcatcgccaggtgagtcgacgagcaagcccggcggatcaggcagcgtgcttgcagatttgacttgcaacgcccgcattgtgtcgacgaaggcttttggctcctctgtcgctgtctcaagcagcatctaaccctgcgtcgccgtttccatttgcaggatccccaagaccaatcgaattcctgcacgcatcccatatcccatggaagcttgcatgccgggcgcgccagaaggagcgcagccaaaccaggatgatgtttgatggggtatttgagcacttgcaacccttatccggaagccccctggcccacaaaggctaggcgccaatgcaagcagttcgcatgcagcccctggagcggtgccctcctgataaaccggccagggggcctatgttctttacttttttacaagagaagtcactcaacatctaaacatatggccaagctgaccagcgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtgagtcgacgagcaagcccggcggatcaggcagcgtgcttgcagatttgacttgcaacgcccgcattgtgtcgacgaaggcttttggctcctctgtcgctgtctcaagcagcatctaaccctgcgtcgccgtttccatttgcaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggacgccccggtgaagcagaccctgaacttcgacctgctgaagctggcgggcgacgtggagagcaacccgggccccgtcgacatgcatgcacgcaagatgggtgccctcgcggtgctcgccgtcgcttgcctcgcggcagtggcatcggttgcgcatgcggccgacaccaaactcgagatgttttaaggatccccgctccgtgtaaatggaggcgctcgttgatctgagccttgccccctgacgaacggcggtggatggaagatactgctctcaagtgctgaagcggtagcttagctccccgtttcgtgctgatcagtctttttcaacacgtaaaaagcggaggagttttgcaattttgttggttgtaacgatcctccgttgattttggcctctttctccatgggcgggctgggcgtatttgaagcgggtaccagagaccttaattaagcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaagacgtcccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggtgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataactgtcagaccaagtttactcatatatactttagattgatttaaaacttcatttttaatttaaaaggatctaggtgaagatcctt

SEQ ID NO: 1515 - protein, 181 aa, Aliatypus gulosus; identical to SEQ ID NO: 1077

SEQ ID NO: 1516 - protein, 181 aa, Aliatypus gulosus; identical to SEQ ID NO: 1078

SEQ ID NO: 1517 - protein, 181 aa, Aliatypus gulosus; identical to SEQ ID NO: 1079

SEQ ID NO: 1518 - protein, 181 aa, Aliatypus gulosus; identical to SEQ ID NO: 1081

SEQ ID NO: 1519 - protein, 181 aa, Aliatypus gulosus; identical to SEQ ID NO: 1082

SEQ ID NO: 1520 - protein, 181 aa, Aliatypus gulosus; identical to SEQ ID NO: 1083

SEQ ID NO: 1521 - protein, 169 aa, Aptostichus sp.; identical to SEQ ID NO: 1084

SEQ ID NO: 1522 - protein, 169 aa, Aptostichus sp.; identical to SEQ ID NO: 1085

SEQ ID NO: 1523 - protein, 179 aa, Aptostichus sp.; identical to SEQ ID NO: 1089

SEQ ID NO: 1524 - protein, 179 aa, Aptostichus sp.; identical to SEQ ID NO: 1090

SEQ ID NO: 1525 - protein, 52 aa, Araneus diadematus
GAGAGAGVGVGGAGGYGQGYGAGAGAGAGAGAGAGGAGGYGQGYGAGAAAAA

SEQ ID NO: 1526 - protein, 42 aa, Araneus diadematus
GAGAGAAGGYGGGSGAGAGGAGGYGQGYGAGSGAGAGAAAAA

SEQ ID NO: 1527 - protein, 48 aa, Araneus diadematus
GASAGAAGGYGGGAGVGAGAGAGAAGGYGQSYGSGAGAGAGAGAAAAA

SEQ ID NO: 1528 - protein, 36 aa, Araneus diadematus
GAGGGGQGGLGSGGAGQGYGAGLGGQGGASAAAAAA

SEQ ID NO: 1529 - protein, 42 aa, Araneus diadematus
GGQGGQGGQGGYGGLGSQGAGGAGQLGYGAGQESAAAAAAAA

SEQ ID NO: 1530 - protein, 43 aa, Araneus diadematus
GGAGGGGQGGLGAGGAGQGYGAAGLGGQGGAGQGGGSGAAAAA

SEQ ID NO: 1531 - protein, 39 aa, Araneus diadematus
GGYGPGSGQQGPSQQGPGQQGPGGQGPYGPGASAAAAAA

SEQ ID NO: 1532 - protein, 29 aa, Araneus diadematus
GGYGPGSGQQGPGGQGPYGPGSSAAAAAA

SEQ ID NO: 1533 - protein, 31 aa, Araneus diadematus
GGNGPGSGQQGAGQQGPGQQGPGASAAAAAA

SEQ ID NO: 1534 - protein, 34 aa, Araneus diadematus
GGYGPGSGQQGPGQQGPGGQGPYGPGASAAAAAA

SEQ ID NO: 1535 - protein, 33 aa, Araneus diadematus
GGYGPGSGQGPGQQGPGGQGPYGPGASAAAAAA

SEQ ID NO: 1536 - protein, 39 aa, Araneus diadematus
GGYGPGSGQQGPGQQGPGQQGPGGQGPYGPGASAAAAAA

SEQ ID NO: 1537 - protein, 33 aa, Araneus diadematus
GGYGPGYGQQGPGQQGPGGQGPYGPGASAASAA

SEQ ID NO: 1538 - protein, 35 aa, Araneus diadematus
SGGYGPGSGQQGPGQQGPGGQGPYGPGASAAAAAA

SEQ ID NO: 1539 - protein, 44 aa, Araneus diadematus
GGYGPGSGQQGPGQQGPGQQGPGQQGPGGQGPYGPGASAAAAAA

SEQ ID NO: 1540 - protein, 66 aa, Araneus diadematus
GGYGPGSGQQGPGQQGPGQQGPGQQGPGQQGPGQQGPGQQGPGQQGPGQQGPGGQGAYGPGASAAA

SEQ ID NO: 1541 - protein, 62 aa, Araneus diadematus
GAAGGYGPGSGQQGPGQQGPGQQGPGQQGPGQQGPGQQGPGQQGPGQQGPYGPGASAAAAAA

SEQ ID NO: 1542 - protein, 36 aa, Araneus diadematus
GSGPGGYGPENQGPSGPGGYGPGGSGSSAAAAAAAA

SEQ ID NO: 1543 - protein, 48 aa, Araneus diadematus
SGPGGYGPGSQGPSGPGGSGGYGPGSQGASGPGGPGASAAAAAAAAAA

SEQ ID NO: 1544 - protein, 35 aa, Araneus diadematus
SGPGGYGPGSQGPSGPGAYGPGGPGSSAAAAAAAA

SEQ ID NO: 1545 - protein, 34 aa, Araneus diadematus
SGPGGYGPGSQGPSGPGVYGPGGPGSSAAAAAAA

SEQ ID NO: 1546 - protein, 43 aa, Araneus diadematus
SGPGGYGPGSQGPSGPGGSGGYGPGSQGGSGPGASAAAAAAAA

SEQ ID NO: 1547 - protein, 193 aa, Atypoides riversi; identical to SEQ ID NO: 1097

SEQ ID NO: 1548 - protein, 193 aa, Atypoides riversi; identical to SEQ ID NO: 1098

SEQ ID NO: 1549 - protein, 193 aa, Atypoides riversi; identical to SEQ ID NO: 1099

SEQ ID NO: 1550 - protein, 193 aa, Atypoides riversi; identical to SEQ ID NO: 1100

SEQ ID NO: 1551 - protein, 193 aa, Atypoides riversi; identical to SEQ ID NO: 1101

SEQ ID NO: 1552 - protein, 193 aa, Atypoides riversi; identical to SEQ ID NO: 1102

SEQ ID NO: 1553 - protein, 193 aa, Atypoides riversi; identical to SEQ ID NO: 1103

SEQ ID NO: 1554 - protein, 170 aa, Bothriocyrtum californicum
SSARSSSAAAASAAAFSSLSRALIYRLQQNQDFIYTFNSIETSDAARAITYSSALAAANAMGAGSSASQAVAFAAAKAAEGVPIRSSSYAYAEAITNAITPHFLALHLVNSANVDAFASDFTSSFASATASAASASAAASSAASAAAAATASSSSTSTSTKTTSSAAAAA

SEQ ID NO: 1555 - protein, 175 aa, Bothriocyrtum californicum; identical to SEQ ID NO: 1105

SEQ ID NO: 1556 - protein, 175 aa, Bothriocyrtum californicum; identical to SEQ ID NO: 1106

SEQ ID NO: 1557 - protein, 175 aa, Bothriocyrtum californicum; identical to SEQ ID NO: 1107

SEQ ID NO: 1558 - protein, 175 aa, Bothriocyrtum californicum
RAAASSRARAEAAAASSAAASAAAASSAFAEELTFLLRQSPNFISAFGSTASSSEATALARSSAIAAARAVGVAGAASAIASAAASAAAGVSHGSSAAAYARAIAFAVAQAFAPFGILTLAKAAAFASQFARSFSSSAAASAASAASASAASAKSAAAAAASSSTTSTSTTTTST

SEQ ID NO: 1559 - protein, 180 aa, Bothriocyrtum californicum; identical to SEQ ID NO: 1109

SEQ ID NO: 1560 - protein, 183 aa, Bothriocyrtum californicum; identical to SEQ ID NO: 1110

SEQ ID NO: 1561 - protein, 181 aa, Bothriocyrtum californicum; identical to SEQ ID NO: 1112

SEQ ID NO: 1562 - protein, 175 aa, Bothriocyrtum californicum; identical to SEQ ID NO: 1113

SEQ ID NO: 1563 - protein, 169 aa, Deinopis spinosa; identical to SEQ ID NO: 1114

SEQ ID NO: 1564 - protein, 174 aa, Deinopis spinosa; identical to SEQ ID NO: 1115

SEQ ID NO: 1565 - protein, 180 aa, Deinopis spinosa; identical to SEQ ID NO: 1116

SEQ ID NO: 1566 - protein, 174 aa, Deinopis spinosa; identical to SEQ ID NO: 1117

SEQ ID NO: 1567 - protein, 158 aa, Deinopis spinosa; identical to SEQ ID NO: 1118

SEQ ID NO: 1568 - protein, 159 aa, Deinopis spinosa; identical to SEQ ID NO: 1119

SEQ ID NO: 1569 - protein, 180 aa, Deinopis spinosa; identical to SEQ ID NO: 1120

SEQ ID NO: 1570 - protein, 175 aa, Deinopis spinosa; identical to SEQ ID NO: 1121

SEQ ID NO: 1571 - protein, 233 aa, Dolomedes tenebrosus; identical to SEQ ID NO: 1122

SEQ ID NO: 1572 - protein, 278 aa, Dolomedes tenebrosus; identical to SEQ ID NO: 1123

SEQ ID NO: 1573 - protein, 169 aa, Dolomedes tenebrosus; identical to SEQ ID NO: 1124

SEQ ID NO: 1574 - protein, 126 aa, Plectreurys tristis
GAGAGAGAGAGAGAGAGSGASTSVSTSSSSGSGAGAGAGSGAGSGAGAGSGAGAGAGAGGAGAGFGSGLGLGYGVGLSSAQAQAQAQAAAQAQAQAQAQAYAAAQAQAQAQAQAQAAAAAAAAAAA

SEQ ID NO: 1575 - protein, 126 aa, Plectreurys tristis
GAGAGAGAGAGAGAGAGSGASTSVSTSSSSGSGAGAGAGSGAGSGAGAGSGAGAGAGAGGAGAAFGSGLGLGYGVGLSSAQAQAQAQAAAQAQADAQAQAYAAAQAQAQAQAQAQAAAAAAAAAAA

SEQ ID NO: 1576 - protein, 126 aa, Plectreurys tristis
GAGAGAGAGSGAGAGAGSGASTSVSTSSSSGSGAGAGAGSGAGSGAGAGSGAGAGAGAGGAGAGFGSGLGLGYGVGLSSAQAQAQAQAAAQAQADAQAQAYAAAQAQAQAQAQAQAAAAAAAAAAA

SEQ ID NO: 1577 - protein, 126 aa, Plectreurys tristis
GAGAGAGAGSGAGAGAGSGASTSVSTSSSSGSGAGAGAGSGAGSGAGAGSGAGAGAGAGGAGAGFGSGLGLGYGVGLSSAQAQAQSAAAARAQADAQAQAYAAAQAQAQAQAQAQAAAAAAAAAAA

SEQ ID NO: 1578 - protein, 126 aa, Plectreurys tristis
GAGAGAGAGAGAGAGAGSGASTSVSTSSSSASGAGAGAGSGAGSGAGAGSGAGAGAGAGGAGAGFGSGLGLGYGVGLSSAQAQAQAQAAAQAQAQAQAQALAAAQAQAQAQAQAQAAAATAAAAAA

SEQ ID NO: 1579 - protein, 198 aa, Plectreurys tristis; identical to SEQ ID NO: 1132

SEQ ID NO: 1580 - protein, 198 aa, Plectreurys tristis; identical to SEQ ID NO: 1133

SEQ ID NO: 1581 - protein, 206 aa, Plectreurys tristis; identical to SEQ ID NO: 1135

SEQ ID NO: 1582 - protein, 206 aa, Plectreurys tristis; identical to SEQ ID NO: 1136

SEQ ID NO: 1583 - protein, 209 aa, Plectreurys tristis
GVSLSSSQATSVASAISSSLYAFNYRASAASSAAAQSSAQTASTSAKQTAASTSASTAATSTTQTAATTSASTAASSQTVQKASTSSAASTAAQQTGQSSSVQNQGSSSASSSSVSVSDISDSLTTSLLQSEEFTSAFGSTVSEAEAQSYAEAVAQSTVAQLGIDYSQSSALATAVANAVSQVKQGSSSRAYARAIAYAITTYLKTTRI

SEQ ID NO: 1584 - protein, 251 aa, Plectreurys tristis
ITTITRTQVKSFASAISSSLSTARATSSANAYQEQTTQSSAAASAAAQSSEYQTQNTQSSASAASSDASTSYQTQQSYSDASAASVAAESTSANQAQSTQSSAAASSSTNSAYQSQQSYIDASTVSSASANTAQSTYQVTIPDNTYFAESLSSTLIQHEQFNSKFGSYIPLVTAREYASAMARATALIIGFDSTGTSALESAVAVAVSNVDYASAYSYARAIAFAISNVLTNNGIFASASEALYLAPAMIA

SEQ ID NO: 1585 - protein, 85 aa, Plectreurys tristis
SLHAFGKSSFSESSAFALANSISPSTAITSAQSSSVSAGASSGQSSYDTSSVVSSASSAEATESSSVFDTYQATQIESSAAAAAA

SEQ ID NO: 1586 - protein, 181 aa, Plectreurys tristis
SSSAYDSQFSESSSASSAAASAFSEQTSYDISSDLSSASSATAAAASSSAYESQFSDASSGSSAAAAASSQQNSYDTDALYSASSAASAAASASAYELEFSDASSSSSAVAVASSQQGSYDTSSDFSSASSAAAAAASAYESKFLDASSSSSAAAAASSQQSSYETSSDLVSASSAAAAAA

SEQ ID NO: 1587 - protein, 177 aa, Plectreurys tristis
SASAYQSQFLDASSSSNAAATTSSRQSSYDTSSDFSSASIAAAAAASASSYESQFSDASSSSNAAAAASSQQSSYDTSSDLVSAASASAYESQFLDASSSSNAAATTSSQQSSYDTSSDFSSASIAAAAAASASSYESQFSDASSSSNAAAAASSQQSSYDTSSDLVSASSAAAAAA

SEQ ID NO: 1588 - protein, 228 aa, Plectreurys tristis
SASSYESQFSDASSSSNAAAAASSQQSSYDTSSDLVSASSAAAAAASASAYESQFSDASSSRNAAAAASSQQSSYDTSSDLVSASSAAAAAASASSYESQFLDASSSSNAAATTSSQQSSYDTSSDFSSASIAAAVAASASSYESQFSDASSSSKAAAAASSQQSSYDTSSDLVSASSAAAAAASASSYESQFSDASSSSNAAAAASSQQSSYDTSSDFSSANSAALA

SEQ ID NO: 1589 - protein, 239 aa, Plectreurys tristis; identical to SEQ ID NO: 1140

SEQ ID NO: 1590 - protein, 239 aa, Plectreurys tristis; identical to SEQ ID NO: 1142

SEQ ID NO: 1591 - protein, 239 aa, Plectreurys tristis; identical to SEQ ID NO: 1143

SEQ ID NO: 1592 - protein, 239 aa, Plectreurys tristis; identical to SEQ ID NO: 1144

SEQ ID NO: 1593 - protein, 242 aa, Plectreurys tristis; identical to SEQ ID NO: 1145

SEQ ID NO: 1594 - protein, 245 aa, Plectreurys tristis; identical to SEQ ID NO: 1146

SEQ ID NO: 1595 - protein, 194 aa, Agelenopsis aperta; identical to SEQ ID NO: 1148

SEQ ID NO: 1596 - protein, 194 aa, Agelenopsis aperta; identical to SEQ ID NO: 1147

SEQ ID NO: 1597 - protein, 182 aa, Araneus gemmoides; identical to SEQ ID NO: 1149

SEQ ID NO: 1598 - protein, 182 aa, Araneus gemmoides; identical to SEQ ID NO: 1150

SEQ ID NO: 1599 - protein, 176 aa, Argiope amoena; identical to SEQ ID NO: 1153

SEQ ID NO: 1600 - protein, 180 aa, Argiope argentata; identical to SEQ ID NO: 1154

SEQ ID NO: 1601 - protein, 180 aa, Argiope argentata; identical to SEQ ID NO: 1155

SEQ ID NO: 1602 - protein, 180 aa, Argiope argentata; identical to SEQ ID NO: 1156

SEQ ID NO: 1603 - protein, 180 aa, Argiope aurantia; identical to SEQ ID NO: 1158

SEQ ID NO: 1604 - protein, 180 aa, Argiope aurantia; identical to SEQ ID NO: 1159

SEQ ID NO: 1605 - protein, 180 aa, Argiope bruennichi
GNVAYQLGFNVANTLGIGNAPGLGNALSQAVSSVGVGASSSTYANAVSNAVGQFLAGQGVLNAGNAGSLASSFANALSASAASVASSAAAQSAFQGQAAASAFSRAASQRASQSAARSGAQSSSYTTTTSTSGSQAASQSASSAAAQASASSFAQASSASLAASSAFSSAFSSANSLSAL

SEQ ID NO: 1606 - protein, 180 aa, Argiope bruennichi
GNVGYQLGFNVANTLGIGNAPGLGNALSQAVSSVGVGASSSAYANAVSNAVGQFLAGQGVLNAGNAGSLASSFANALSASAASVASSAAAQSASQSQAAAAAFSRAASQSASQSAARSGAQSSSTTTTTSTSGSQAASQSASSAAAQASASSFAQASSASLAASSAFSSAFSSANSLSAL

SEQ ID NO: 1607 - protein, 181 aa, Argiope bruennichi
GNVGYQIGFNVANTLGIGNAPGLGNALSQAVSSVGVGASSSAYANAVSNAVGQFLAGQGVLNAGNAGSSLASTFANALSASAASVASSAAAQSAFQSQAAASAFSRAASQSTSQSAARSGAQSSSTTTTTSTSGSQAASQSASSAAAQASASSFAQASSASLAASSAFSSAFSSANSLSAL

SEQ ID NO: 1608 - protein, 180 aa, Argiope bruennichi; identical to SEQ ID NO: 1161

SEQ ID NO: 1609 - protein, 180 aa, Argiope bruennichi; identical to SEQ ID NO: 1162

SEQ ID NO: 1610 - protein, 180 aa, Argiope bruennichi; identical to SEQ ID NO: 1164

SEQ ID NO: 1611 - protein, 180 aa, Argiope bruennichi; identical to SEQ ID NO: 1165

SEQ ID NO: 1612 - protein, 180 aa, Argiope bruennichi; identical to SEQ ID NO: 1167

SEQ ID NO: 1613 - protein, 180 aa, Argiope bruennichi; identical to SEQ ID NO: 1169

SEQ ID NO: 1614 - protein, 180 aa, Argiope bruennichi; identical to SEQ ID NO: 1171

SEQ ID NO: 1615 - protein, 180 aa, Argiope bruennichi; identical to SEQ ID NO: 1177

SEQ ID NO: 1616 - protein, 180 aa, Argiope bruennichi; identical to SEQ ID NO: 1180

SEQ ID NO: 1617 - protein, 180 aa, Argiope bruennichi
GSLASSFASALSASAASVASSAAAQSASQSQAAASAFSRAASQSASQSAARSGARSSSTTTTTSASGSQAASQSASSAASQASASSFAQASSASLAASSSFSSAFSSANSLSALGNVAYQLGFNVANTLGIGNAPGLGAALSQAVSSVGVGASSSTYANVVSNAVGQFLAGQGVLNAANA

SEQ ID NO: 1618 - protein, 180 aa, Argiope bruennichi
GSLASSFASALSASAASVASSAAAQSASQSQAAASAFSRAASQSASQSASRSGAQSSSTTTTTSASGSQAASQSASSAASQASASSFAQASSASLAASSSFSSAFSSANSLSALGNVAYQLGFNVANTLGIGNAPGLGAALSQAVSSVGVGASSSTYANVVSNAVGQFLAGQGVLNAANA

SEQ ID NO: 1619 - protein, 180 aa, Argiope bruennichi
GSLASSFASALSASAASVASSAAAQSASQSQAAASAFSRAASQSGSQSASRSGAQSSSTTTTTSASGSQAASQSASSAASQASASSFAQASSASLAASSSFSSAFSSANSLSALGNVAYQLGFNVANTLGIGNAPGLGAALSQAVSSVGVGASSSTYANVVSNAVGQFLAGQGVLNAANA

SEQ ID NO: 1620 - protein, 186 aa, Avicularia juruensis; identical to SEQ ID NO: 1189

SEQ ID NO: 1621 - protein, 186 aa, Avicularia juruensis; identical to SEQ ID NO: 1190

SEQ ID NO: 1622 - protein, 188 aa, Deinopis spinosa; identical to SEQ ID NO: 1191

SEQ ID NO: 1623 - protein, 199 aa, Deinopis spinosa; identical to SEQ ID NO: 1192

SEQ ID NO: 1624 - protein, 206 aa, Deinopis spinosa; identical to SEQ ID NO: 1193

SEQ ID NO: 1625 - protein, 184 aa, Latrodectus hesperus; identical to SEQ ID NO: 1194

SEQ ID NO: 1626 - protein, 184 aa, Latrodectus hesperus; identical to SEQ ID NO: 1195

SEQ ID NO: 1627 - protein, 184 aa, Latrodectus hesperus; identical to SEQ ID NO: 1196

SEQ ID NO: 1628 - protein, 184 aa, Latrodectus hesperus; identical to SEQ ID NO: 1198

SEQ ID NO: 1629 - protein, 184 aa, Latrodectus hesperus; identical to SEQ ID NO: 1199

SEQ ID NO: 1630 - protein, 184 aa, Latrodectus hesperus
GILTQENAAGLASSVSSAISSAASSVAAQAASAAQSSAFAQSQAAAQAFSQAASRSASQSAAQAGSSSTSTTTTTSQAASQAASQSASSSYSAASQSAFSQASSSALASSSSFSSAFSSASSASAVGQVGYQIGLNAAQTLGISNAPAFADSVSQAVRTVGVGASPFQYANAVSNAFGQLLGGQ

SEQ ID NO: 1631 - protein, 185 aa, Latrodectus hesperus
GILTQENAAGLASSVSSAISSAASSVAAQAASAAQSSAFAQSQAAAQAFSQAASRSASQSAAQAGSSSTSTTTTTSQAASQAASQSASSSYSAASQSAFSQASSSSALASSSSFSSAFSSASSASAVGQVGYQIGLNAAQTLGISNAPAFADAVSQAVRTVGVGASPFQYANAVSNAFGQLLGGQ

SEQ ID NO: 1632 - protein, 184 aa, Latrodectus hesperus
GILTQENAAGLASSVSSAISSAASSVAAQAASAAQSSAFAQSQAAAQAFSQAASRSASQSAAQAGSSSTSTTTTTSQAASQAASQSASSSSSAASQSAFSQASSSALASSSSFSSAFSSASSASAVGQVGYQIGLNAAQTLGISNAPAFADAVSQAVRTVGVGASPFQYASAVSNAFGQLLGGQ

SEQ ID NO: 1633 - protein, 184 aa, Latrodectus hesperus
GILTQENAAGLASSVSSAISSAASSVAAQAASAAQSSAFAQSQAAAQAFSQAASRSASQSAAQAGSSSTSTTTTTSQAASQAASQSASSSYSAASQSAFSQASSSALASSSSFSSAFSSASSASAVGQVGYQIGLNAAQTLGISNAPAFADAVSQAVRTVGVGASPFQYANAVSNAFGQLLGEQ

SEQ ID NO: 1634 - protein, 171 aa, Nephila antipodiana; identical to SEQ ID NO: 1200

SEQ ID NO: 1635 - protein, 171 aa, Nephila clavata; identical to SEQ ID NO: 1201

SEQ ID NO: 1636 - protein, 171 aa, Nephila clavata; identical to SEQ ID NO: 1203

SEQ ID NO: 1637 - protein, 171 aa, Nephila clavata; identical to SEQ ID NO: 1206

SEQ ID NO: 1638 - protein, 171 aa, Nephila clavipes; identical to SEQ ID NO: 1209

SEQ ID NO: 1639 - protein, 171 aa, Nephila clavipes; identical to SEQ ID NO: 1210

SEQ ID NO: 1640 - protein, 174 aa, Nephilengys cruentata; identical to SEQ ID NO: 1211

SEQ ID NO: 1641 - protein, 302 aa, Uloborus diversus; identical to SEQ ID NO: 1213

SEQ ID NO: 1642 - protein, 278 aa, Uloborus diversus; identical to SEQ ID NO: 1212

SEQ ID NO: 1643 - protein, 302 aa, Uloborus diversus; identical to SEQ ID NO: 1215

SEQ ID NO: 1644 - protein, 143 aa, Araneus ventricosus; identical to SEQ ID NO: 1216

SEQ ID NO: 1645 - protein, 152 aa, Araneus ventricosus; identical to SEQ ID NO: 1217

SEQ ID NO: 1646 - protein, 132 aa, Araneus ventricosus; identical to SEQ ID NO: 1218

SEQ ID NO: 1647 - protein, 180 aa, Araneus ventricosus; identical to SEQ ID NO: 1219

SEQ ID NO: 1648 - protein, 182 aa, Araneus ventricosus; identical to SEQ ID NO: 1220

SEQ ID NO: 1649 - protein, 216 aa, Araneus ventricosus; identical to SEQ ID NO: 1222

SEQ ID NO: 1650 - protein, 214 aa, Araneus ventricosus; identical to SEQ ID NO: 1223

SEQ ID NO: 1651 - protein, 233 aa, Argiope argentata; identical to SEQ ID NO: 1224

SEQ ID NO: 1652 - protein, 19 aa, Deinopis spinosa
GQYGQGPGAAAAAAAAAAA

SEQ ID NO: 1653 - protein, 31 aa, Deinopis spinosa
GSGDGQGGQGDYGGGRGQYGSRSSGAAAAAA

SEQ ID NO: 1654 - protein, 32 aa, Deinopis spinosa
GGSGRQGGQRGYGGGAVTGAGAGAGAGGGSET

SEQ ID NO: 1655 - protein, 146 aa, Deinopis spinosa
GATAATTAFAQSMSSALASSPSFSSLFSSGLQTQDAVSASVSVAQTLANQVGLDNSATANLLQLVQRYVSSVGAYADAVAYANAISKALGSVLANTGQITTSTAYSTANSFAQTVTTYINNVSPRVLFSPPIGILPVPSGEAAPRE

SEQ ID NO: 1656 - protein, 30 aa, Deinopis spinosa
GGQGDQGYRVQGGYGPVSNAAASAAAAASA

SEQ ID NO: 1657 - protein, 23 aa, Deinopis spinosa
GGGQGAGQGGYGPSSGAAAASAA

SEQ ID NO: 1658 - protein, 51 aa, Deinopis spinosa
GDSGGRGGRQGYVGGAGAGAGSGAGGQGGQGQYGPGTNGAAAAAAASAASA

SEQ ID NO: 1659 - protein, 39 aa, Deinopis spinosa
GGSGSQVSQDVDQGYGGGAGLGGSGSGSGAAAAAAAAAA

SEQ ID NO: 1660 - protein, 148 aa, Latrodectus hesperus
GGYGRGQGAGAGVGAGAGAAAGAAAIARAGGYGQGAGGYGQGQGAGAAAGAAAGAGAGGYGQGAGGYGRGQGAGAGAGAGAGARGYGQGAGAGAAAGAAASAGAGGYGQGAGGYGQGQGAGAAAGAAASAGAGGYGQGAGGYGQGQGA

SEQ ID NO: 1661 - protein, 148 aa, Latrodectus hesperus; identical to SEQ ID NO: 1227

SEQ ID NO: 1662 - protein, 108 aa, Metepeira grandiosa
GAGYGAGAGAGAGYGAGAGAGAGAGAVAAGGAGAGAGRGYGAGAGAGAGAAGGAGAGAGAGYGAGAGRGYGAGSGAGAGAGAAGGAGAGAGAGYGAGAGAGAGAASGA

SEQ ID NO: 1663 - protein, 92 aa, Metepeira grandiosa
GAGAGYGAGAGRGYGAGAGAGSGAGAGAGAAGGAGAGYGAGAGAGAGSGAAAAGGAGAGAGYGAGAGRGYGAGAGAGSGAGAGAGEAGGAGA

SEQ ID NO: 1664 - protein, 145 aa, Nephila clavipes; identical to SEQ ID NO: 1231

SEQ ID NO: 1665 - protein, 150 aa, Nephila clavipes; identical to SEQ ID NO: 1232

SEQ ID NO: 1666 - protein, 153 aa, Nephila clavipes; identical to SEQ ID NO: 1233

SEQ ID NO: 1667 - protein, 161 aa, Nephila clavipes; identical to SEQ ID NO: 1234

SEQ ID NO: 1668 - protein, 179 aa, Nephilengys cruentata; identical to SEQ ID NO: 1235

SEQ ID NO: 1669 - protein, 164 aa, Nephilengys cruentata; identical to SEQ ID NO: 1236

SEQ ID NO: 1670 - protein, 50 aa, Nephilengys cruentata
GGAGGYGVGQGYGAGAGAGAAAGAGAGGAGGYGAGQGYGAGAGVGAAAAA

SEQ ID NO: 1671 - protein, 64 aa, Nephilengys cruentata
GAGAGVGGAGGYGRGAGAGAGAGAGAAAGAGAGAAAGAGAGGAGGYGAGQGYGAGAGVGAAAAA

SEQ ID NO: 1672 - protein, 68 aa, Nephilengys cruentata
GAGAGVGGAGGYGRGAGAGAGAGAGGAGGYGRGAGAGAGAGAGAGGAGGYGAGQGYGAGAGAGAAAAA

SEQ ID NO: 1673 - protein, 50 aa, Nephilengys cruentata
GAGAGAGGAGGYGRGAGAGAGAGAGAGGAGGYGAGQGYGAGAGAGAAAAA

SEQ ID NO: 1674 - protein, 46 aa, Nephilengys cruentata
GAGAGAGGAGGYGRGAGAGAGAGAGAGGAGGYGRGAGAGAGAGAAA

SEQ ID NO: 1675 - protein, 54 aa, Nephilengys cruentata
GAGAGGAGRYGAGQGYGAGAGAGAAAGAGAGGAGGYGAGQGYGAGAGAGAAAAA

SEQ ID NO: 1676 - protein, 36 aa, Nephilengys cruentata
GAGAGVGGAGGYGSGAGAGAGAGAGAASGAAAGAAA

SEQ ID NO: 1677 - protein, 70 aa, Nephilengys cruentata
GAGAGGAGGYGTGQGYGAGAGAGAGAGAGGAGGYGRGAGAGAGAGAGGAGGYGAGQGYGAGAGAGAAAAA

SEQ ID NO: 1678 - protein, 80 aa, Nephilengys cruentata
GDGAGAGGAGGYGRGAGAGAGAGAAAGAGAGGAGGYGAGQGYGAGAGAGAAAGAGAGGAGGYGAGQGYGAGAGAGAAAAA

SEQ ID NO: 1679 - protein, 102 aa, Nephilengys cruentata
GAGAGVGGAGGYGRGAGAGAGAAAGAGAGAAAGAGAGGAGGYGTGQGYGAGAGAGAGAGGAGGYGRGAGAGAGAGAGAGGAGEYGAGQGYGAGAGAGAAAAA

SEQ ID NO: 1680 - protein, 80 aa, Nephilengys cruentata
GAGAGAGGAGGYGRGAGAGAGAGAAAGAGAGGAGGYGARQGYGAGAGAGAAAGAGAGGAGGYGAGQGYGAGAGAGAAAAA

SEQ ID NO: 1681 - protein, 61 aa, Nephilengys cruentata
GAGAGAGGAGGYGRGAGAGAGAGAGAAAGQGYGSGAGAGAGASAGGAGSYGRGAGAGAAAA

SEQ ID NO: 1682 - protein, 74 aa, Nephilengys cruentata
SGAGAGGYGAGQGYGAGAGAVASAAAGAGSGAGGAGGYGRGAVAGSGAGAGAGAGGAGGYGAGAGAGAAAGAVA

SEQ ID NO: 1683 - protein, 25 aa, Nephilengys cruentata
GGSGGYGGRQGGYSAGAGAGAAAAA

SEQ ID NO: 1684 - protein, 24 aa, Nephilengys cruentata
GAGAGGTGGYGRGSGAGAAAGAAA

SEQ ID NO: 1685 - protein, 37 aa, Nephilengys cruentata
GAGAAGGYGGYGAGAGAGAGGARGYGGGAGAGAGAAA

SEQ ID NO: 1686 - protein, 42 aa, Nephilengys cruentata
GAGAGAGAGAGAAAGAGAGGAGGYGAGQGYGAGAGAGAAAAA

SEQ ID NO: 1687 - protein, 28 aa, Nephilengys cruentata
GAGAGAGGAGGFGRGAGAGAGAGAGAAA

SEQ ID NO: 1688 - protein, 28 aa, Nephilengys cruentata
GAGAGGAGGYGAGQGYGAGAGAGAAAAA

SEQ ID NO: 1689 - protein, 28 aa, Nephilengys cruentata
GAGAGAGGAGGYGRGAGAGAGAGAAAAA

SEQ ID NO: 1690 - protein, 80 aa, Nephilengys cruentata
GAGAGTGGAGGYGAGQGYGAGAGAGAGAGAGAGAGGAGGYGRGAGAGAGAGAGAGGAGGYGVGQGYGAGAGAGAGAGSAA

SEQ ID NO: 1691 - protein, 58 aa, Parawixia bistriata
GAGAGGGYGGGYGAGGGAGAGAGAGAGAGAGAGAGRGGAGGYGAGAGAGAGAAAAAAA

SEQ ID NO: 1692 - protein, 50 aa, Parawixia bistriata
GAGAGGGYGGGYGAGVGAGAGAGAGAGGGYGGGYGAGAGAGAGAAAAAAA

SEQ ID NO: 1693 - protein, 56 aa, Parawixia bistriata
GAGAGGGYGGGYGAGGGAGAGAGAGAGAGAGAGAGRGGAVGYGAGAGAGAAAAAAA

SEQ ID NO: 1694 - protein, 74 aa, Parawixia bistriata
GAGAGGGYGGGYGAGGGAGAGAGAGAGGGYGGGYGAGGGAGAGAGAGAGAGRGGAGGYGAGAGAAAGAAAAAAA

SEQ ID NO: 1695 - protein, 54 aa, Parawixia bistriata
GAGAGGGYGGGYGAGGGAGAGAGAAAGAGAGAGRGGAGGYGAGAGAGAGAAAAA

SEQ ID NO: 1696 - protein, 52 aa, Parawixia bistriata
GAGAGGGYGGGYSAGGGAGAGSGAAAGAGAGRGGAGGYSAGAGTGAGAAAGA

SEQ ID NO: 1697 - protein, 53 aa, Uloborus diversus
GSGAGAGSGYGAGAGAGAGSGYGAGSSASAGSAINTQTVTSSTTTSSQSSAAA

SEQ ID NO: 1698 - protein, 57 aa, Uloborus diversus
TGAGYGTGAGTGASAGAAASGAGAGYGGQAGYGQGAGASARAAGSGYGAGAGAAAAA

SEQ ID NO: 1699 - protein, 22 aa, Uloborus diversus
GSGYGAGAGAGAGSGYGAGAAA

SEQ ID NO: 1700 - protein, 107 aa, Uloborus diversus
GSGYGAGAGAGAGSGYGAGAGAGSGYGAGAGAGAGSGYVAGAGAGAGAGSGYGAGAGAGAGSSYSAGAGAGAGSGYGAGSSASAGSAVSTQTVSSSATTSSQSAAAA

SEQ ID NO: 1701 - protein, 21 aa, Uloborus diversus
TGAAYGTRASTGSGASAGAAA

SEQ ID NO: 1702 - protein, 21 aa, Uloborus diversus
SGAGAGYGGQAGYGQGGGAAA

SEQ ID NO: 1703 - protein, 25 aa, Uloborus diversus
YRAGAGSQAAYGQGASGSSGAAAAA

SEQ ID NO: 1704 - protein, 25 aa, Uloborus diversus
GAGAGYGGQVGYGQGAGASAGAAAA

SEQ ID NO: 1705 - protein, 25 aa, Uloborus diversus
GAGAGYGGQAGYGQGAGGSAGAAAA

SEQ ID NO: 1706 - protein, 23 aa, Uloborus diversus
GAGAGRQAGYGQGAGASARAAAA

SEQ ID NO: 1707 - protein, 19 aa, Uloborus diversus
GAGTGYGQGAGASAGAAAA

SEQ ID NO: 1708 - protein, 24 aa, Uloborus diversus
GAGAGSQVGYGQGAGASSGAAAAA

SEQ ID NO: 1709 - protein, 26 aa, Uloborus diversus
GAGAGYGGQVGYEQGAGASAGAEAAA

SEQ ID NO: 1710 - protein, 26 aa, Uloborus diversus
SSAGAGYGGQAGYGQGAGASAGAAAA

SEQ ID NO: 1711 - protein, 25 aa, Uloborus diversus
GAGAGYRGQAGYIQGAGASAGAAAA

SEQ ID NO: 1712 - protein, 26 aa, Uloborus diversus
GAGVGYGGQAGYGQGAGASAGAAAAA

SEQ ID NO: 1713 - protein, 23 aa, Uloborus diversus
GAGAGRQAGYGQGAGASAGAAAA

SEQ ID NO: 1714 - protein, 24 aa, Uloborus diversus
GADAGYGGQAGYGQGAGASAGAAA

SEQ ID NO: 1715 - protein, 26 aa, Uloborus diversus
SGAGAGYGGQAGYGQGAGASAGAAAA

SEQ ID NO: 1716 - protein, 24 aa, Uloborus diversus
GAGAGYLGQAGYGQGAGASAGAAA

SEQ ID NO: 1717 - protein, 27 aa, Uloborus diversus
GAGAGYGGQAGYGQGTGAAASAAASSA

SEQ ID NO: 1718 - protein, 24 aa, Uloborus diversus
GAASSQVVSRTTTTTSQSAAGGAA

SEQ ID NO: 1719 - protein, 14 aa, Uloborus diversus
SGYSTGVGSGAAAA

SEQ ID NO: 1720 - protein, 24 aa, Uloborus diversus
TSGAGYGGQRGYGTGAGAAAGAAA

SEQ ID NO: 1721 - protein, 28 aa, Uloborus diversus
SGTGAGYGGQAGYGQGAGASAAAAASAA

SEQ ID NO: 1722 - protein, 106 aa, Araneus ventricosus
PGGPGGVGGPLGAGAGGVGPGGAGAYGPGGAGAYGPGGAGAYGPGGAGPGGAGPYGPGGPGGAGPGGEGPVTVDVEVSVGGAPGGGPGGAGPGGAGVGPGGAPGAP

SEQ ID NO: 1723 - protein, 179 aa, Araneus ventricosus; identical to SEQ ID NO: 1250

SEQ ID NO: 1724 - protein, 114 aa, Araneus ventricosus
GGPGGPGGPGGPGGAYGPGGGGPSGPGGVGAGGAGPYGPGGLGPVGAGPYGLGGASAGGAGPYGPGGPSGAGPGGEGPVAVDVEVSVGGAPGGGAGGAGPGGAGVGPGGAPGAP

SEQ ID NO: 1725 - protein, 124 aa, Argiope trifasciata
GGAGAGGVGPGGVSGGAGGAGGSGVTVVESVSVGGAGGPGAGGVGPGGVGPGGVGPGGIYGPGGAGGLYGPGAGGAFGPGGGAGAPGGPGGPGGPGGPGGLGGGVGGAGTGGGVGPGAGGVGPS

SEQ ID NO: 1726 - protein, 114 aa, Argiope trifasciata
GGAGGTGPVSVSSTVSVGGAGGPGAGGPGAGGAGAGGVGPGGFGGPGGFGGAGGPGGPGGPGGAGGGAGGAGGLYGPGGAGGLYGPGGLYGPGGAGVPGAPGASGRAGGIGGAA

SEQ ID NO: 1727 - protein, 268 aa, Argiope trifasciata; identical to SEQ ID NO: 1252

SEQ ID NO: 1728 - protein, 268 aa, Argiope trifasciata; identical to SEQ ID NO: 1253

SEQ ID NO: 1729 - protein, 114 aa, Nephila clavipes
GGAGAGGSGPGGAGPGNVGPGRSGPGGVGPGGSGPGGVGPGSFGPGGVGPGGSGPGGVGSGGSGQGGVRPSGSGPGGVGTGGVGPGGAGGPYGPGGSGPGSAGSAGGTYGPGGF

SEQ ID NO: 1730 - protein, 71 aa, Nephila clavipes
GGPGGFGGPGGAGGPYGPGGAGGPYGPGGAGGPYGPGGAGGPYGPGGAGGPYGPGGAGGSYGLGGAGGSGG

SEQ ID NO: 1731 - protein, 71 aa, Nephila clavipes
VGPGGSGPGGYGPGGAGPGGYGPGGSGPGGYGPGGSGSGGYGPGGSGPGGSGPGGYGPGGTGPGGSESGGY

SEQ ID NO: 1732 - protein, 71 aa, Nephila clavipes
GPGGSGPGGSGPGGSGPGGSGPGGYGPGGSGPSSFVPGGSGPGGSGPGGAGPGGAGPGGVGLGGAGRGGAG

SEQ ID NO: 1733 - protein, 420 aa, Nephila clavipes
GVSYGPGGAGGPYGPGGPYGPGGEGPGGAGGPYGPGGVGPGGSGPGGYGPGGAGPGGYGPGGSGPGGYGPGGSGPGGYGPGGSGPGGYGPGGSGPGGYGPGGYGPGGSGPGGSGPGGSGPGGYGPGGTGPGGSGPGGYGPGGSGPGGSGPGGYGPGGSGPGGFGPGGSGPGGYGPGGSGPGGAGPGGVGPGGFGPGGAGPGGAAPGGAGPGGAGPGGAGPGGAGPGGAGPGGAGPGGAGGAGGAGGSGGAGGSGGTTIIEDLDITIDGADGPITISEELPISGAGGSGPGGAGPGGVGPGGSGPGGVGPGGSGPGGVGPGGSGPGGVGPGGAGGPYGPGGSGPGGAGGAGGPGGAYGPGGSYGPGGSGGPGGAGGPYGPGGEGPGGAGGPYGPGGAGGPYGPGGAGGPYGPGGEGGPYGP

SEQ ID NO: 1734 - protein, 443 aa, Nephila clavipes
GGSYGPGGAGGPYGPGGPYGPGGEGPGGAGGPYGPGGVGPGGGGPGGYGPGGAGPGGYGPGGSGPGGYGPGGSGPGGYGPGGSGPGGYGPGGSGPGGYGPGGSGPGGSGPGGYGPGGSGPGGSGPGGYGPGGSGPGGYGPGGSGPGGSGPGGYGPGGSGPGGSGPGGYGPGGSGPGGFGPGGFGPGGSGPGGYGPGGSGPGGAGPGGVGPGGFGPGGAGPGGAGPGGAGPGGAGPGGAGPGGAGPGGAGPGGAGPGGAGGAGGAGGAGGSGGAGGSGGTTIIEDLDITIDGADGPITISEELTISGAGGSGPGGAGPGGVGPGGSGPGGVGPGGSGPGGVGPGGSGPGGVGPGGAGGPYGPGGSGPGGAGGAGGPGGAYGPGGSYGPGGSGGPGGAGGPYGPGGEGPGGAGGPYGPGGAGGPYGPGGAGGPYGPGGEGGPYGP

SEQ ID NO: 1735 - protein, 413 aa, Nephila clavipes
GGSYGPGGAGGPYGPGGPYGPGGEGPGGAGGPYGPGGVGPGGGGPGGYGPGGAGPGGYGPGGSGPGGYGPGGSGPGGYGPGGSGPGGYGPGGSGPGGYGPGGSGPGGSGPGGYGPGGSGPGGYGPGGSGPGGSGPGGYGPGGSGPGGFGPGGFGPGGSGPGGYGPGGSGPGGAGPGGVGPGGFGPGGAGPGGAGPGGAGPGGAGPGGAGPGGAGPGGAGPGGAGPGGAGGAGGAGGAGGSGGAGGSGGTTIIEDLDITIDGADGPITISEELTISGAGGSGPGGAGPGGVGPGGSGPGGVGPGGSGPGGVGPGGSGAGGVGPGGAGGPYGPGGSGPGGAGGAGGPGGAYGPGGSYGPGGSGGPGGAGGPYGPGGEGPGGAGGPYGPGGAGGPYGPGGAGGPYGPGGEGGPYGP

SEQ ID NO: 1736 - protein, 404 aa, Nephila clavipes
GGSYGPGGSGGPGGAGGPYGPGGEGPGGAGGPYGPGGAGGPYGPGGAGGPYGPGGEGGPYGPGGSYGPGGAGGPYGPGGPYGPGGEGPGGAGGPYGPGGVGPGGSGPGGYGPGGSGPGGYGPGGAGPGGYGPGGSGPGGYGPGGSGPGGYGPGGSGPGGYGPGGSGPGGYGSGGAGPGGYGPGGSGPGGYGPGGSGPGGYGPGGTGPGGTGPGGSGPGGYGPGGSGPGGSGPGGSGPGGYGPSGSGPGGYGPSGSGPGGYGPGGSGPGGYGPGGSGAGGTGPGGAGGAGGAGGSGGAGGSGGAGGSGGAGGSGGVGGSGGTTITEDLDITIDGADGPITISEELTISGAGGSGPGGAGPGGVGPGGSGPGGVGPGVSGPGGVGPGGSGPGGVGSGGSGPGGVGP

SEQ ID NO: 1737 - protein, 285 aa, Nephilengys cruentata; identical to SEQ ID NO: 1260

SEQ ID NO: 1738 - protein, 269 aa, Nephilengys cruentata; identical to SEQ ID NO: 1261

SEQ ID NO: 1739 - protein, 288 aa, Nephilengys cruentata; identical to SEQ ID NO: 1262

SEQ ID NO: 1740 - protein, 177 aa, Nephila madagascariensis; identical to SEQ ID NO: 1263

SEQ ID NO: 1741 - protein, 191 aa, Nephila madagascariensis; identical to SEQ ID NO: 1264

SEQ ID NO: 1742 - protein, 195 aa, Nephila madagascariensis; identical to SEQ ID NO: 1265

SEQ ID NO: 1743 - protein, 216 aa, Nephila madagascariensis; identical to SEQ ID NO: 1266

SEQ ID NO: 1744 - protein, 198 aa, Nephila madagascariensis; identical to SEQ ID NO: 1267

SEQ ID NO: 1745 - protein, 208 aa, Nephila madagascariensis
  MOD_RES (154)..(154): Any amino acid
GYGPGGSGPGGYGPGGSGPGGFGPGGSGPGGYGPGGSGPGGYGPGGSGPGGAGPGGYGPGGTGPGGSGPGGYGPGGSGPGGYGPGGSGPGGYGPGGSGPGGAGPGGAGPGGAGPGGAGPGGVGPGGAGPGGSGPGGAGPGGAGRGGAGRGGAGXGGAGPGGAGGAGGAGGSGGAGGSGGTTVIEDLDITIDGADGPITISEELTINGA

SEQ ID NO: 1746 - protein, 384 aa, Nephila madagascariensis
GAGGSGPGGAGPGGVGPGGSGPGGVGPGGSGPGGVGPGGAGGPYGPGGSGPGGAGGAGGPGGAYGPGGSGGPGGAGGPYGPGGEGPGGAGGPYGPGGEGPGGAGGPYGPGGAGGPYGPGGAGGPYGPGGAGGPYGPGGAGGPYGPGGVGPGGTGPGGYGPGGAGPGGYGPGGSGPGGYGPGGSGPGGYGPGGSGPGGFGPGGSGPGGSGPGGSGPGGYGPGGSGPGGYGPGGSGPGGYGPGGSGPGGYGPGGSGPGGSGPGGYGPGGSGPGGYGPGGSGPGGAGPGGAGPGGVGPGGAGPGGAGPGGVGPGGAGPGGAGPGGAGPGGAGRGGAGPGGAGGAGGAGGSGGAGGSGGTTVIEDLDITIDGADGPITISEELTIGGA

SEQ ID NO: 1747 - protein, 100 aa, Parawixia bistriata
PGGPGGPGGPGAPGGAGGMFGPGGAGGMYGPGGAGGMYGPGGAGRGPGGAGAPGAPGGPGGPGGPGGFGGGAGAGGMVPGGASRGPGGSGPVTVTETVTV

SEQ ID NO: 1748 - protein, 70 aa, Parawixia bistriata
GGAGGPGPGGIGGSSGPGAGGAPGGFGGPGGPGGPGGPGGPGGAAGGPGAGGAGPGGSGPATVSSSVTVV

SEQ ID NO: 1749 - protein, 83 aa, Parawixia bistriata
GAGGPGGPGAGGIVPGGIYGPGGAGGVVPGGIYGPGGVPSGPGGPGGPVGPGGYGAPGGLGVGILPGTASAGTSGPTTVTEVV

SEQ ID NO: 1750 - protein, 376 aa, Latrodectus hesperus
GINVDSDIGSVTSLILSGSTLQMTIPAGGDDLSGGYPGGFPAGAQPSGGAPVDFGGPSAGGDVAAKLARSLASTLASSGVFRAAFNSRVSTPVAVQFTDALVQKIASNLGLDYATASKLRKASQAVSKVRMGSDTNAYALAISSALAEVLSSSGKVADANINQIAPQLASGIVLGVSTTAPQFGVDLSSINVNLDISNVARNMQASIQGGPAPITAEGPDFGAGYPGGAPTDLSGLDMGAPSDGSRGGDATAKLLQALVPALLKSDVFRAIYKRGTRKQVVQYVTNSALQQAASSLGLDASTISQLQTKATQALSSVSADSDSTAYAKAFGLAIAQVLGTSGQVNDANVNQIGAKLATGILRGSSAVAPRLGIDLS

SEQ ID NO: 1751 - protein, 376 aa, Latrodectus hesperus
GINVDSDIGSVTSLILSGSTLQMTIPAGGDDLSGGYPGGFPAGAQPSGGAPVDFGGPSAGGDVAAKLARSLASTLASSGVFRAAFNSRVSTPVAVQLTDALVQKIASNLGLDYATASKLRKASQAVSKVRMGSDTNAYALAISSALAEVLSSSGKVADANINQIAPQLASGIVLGVSTTAPQFGVDLSSINVNLDISNVARNMQASIQGGPAPITAEGPDFGAGYPGGAPTDLSGLDMGAPSDGSRGGDATAKLLQALVPALLKSDVFRAIYKRGTRKQVVQYVTNSALQQAASSLGLDASTISQLQTKATQALSSVSADSDSTAYAKAFGLAIAQVLGTSGQVNDANVNQIGAKLATGILRGSSAVAPRLGIDLS

SEQ ID NO: 1752 - protein, 376 aa, Latrodectus hesperus
GINVDSDIGSVTSLILSGSTLQMTIPAGGDDLSGGYPGGLPSGAQPSGGAPVDFGGPSAGGDVAAKLARSLASTLASSGVFRAAFNSRVSTPVAVQLTDALVQKIASNLGLDYATASKLRKASQAVSKVRMGSDTNAYALAISSALAEVLSSSGKVADANINQIAPQLASGIVLGVSTTAPQFGVDLSSINVNLDISNVARNMQASIQGGPAPITAEGPDFGAGYPGGAPTDLSGLDMGAPSDGSRGGDATAKLLQALVPALLKSDVFRAIYKRGTRKQVVQYVTNSALQQAASSLGLDASTISQLQTKATQALSSVSADSDSTAYAKAFGLAIAQVLGTSGQVNDANVNQIGAKLATGILRGSSAVAPRLGIDLS

SEQ ID NO: 1753 - protein, 376 aa, Latrodectus hesperus
GINVDSDIGSVTSLILSGSTLQMTIPAGGDDLSGGYPGGFPSGAQPSGGAPVDFGGPSAGGDVAAKLARSLASTLASSGVFRAAFNSRVSTPVAVQLTDALVQKIASNLGLDYATASKLRKASQAVSKVRMGSDTNAYALAISSALAEVLLSSGKVADANINQIAPQLASGIVLGVSTAAPQFGVDLSSINVNLDISNVARNMQASIQGGPAPITAEGPDFGAGYPGGAPTDLSGLDMGAPSDGSRGGDATAKLLQALVPALLKSDVFRAIYKRGTRKQVVQYVTNSALQQAASSLGLDASTISQLQTKATQALSSVSADSDSTAYAKAFGLAIAQVLGTSGQVNDANVNQIGAKLATGILRGSSAVAPRLGIDLS

SEQ ID NO: 1754 - protein, 376 aa, Latrodectus hesperus
GINVDSDIGSVTSLILSGSTLQMTIPAGGDDLSGGYPGGFPAGAQPSGGAPVDFGGPSAGGDVAAKLARSLASTLASSGVFRAAFNSRVSTPVAVQLTDALVQKIASNLGLDYATASKLRKASQAVSKVRMGSDTNAYALAISSALAEVLSSSGKVADANINQIAPQLASGIVLGVSTTAPQFGVDLSSINVNLDISNVARNMQASIQGGPAPITAEGPDFGAGYPGGAPADLSGLDMGAPSDGSRGGDATAKLLQALVPALLKSDVFRAIYKRGTRKQVVQYVTNSALQQAASSLGLDASTISQLQTKATQALSSVSADSDSTAYAKAFGLAIAQVLGTSGQVNDANVNQIGAKLATGILRGSSAVAPRLGIDLS

SEQ ID NO: 1755 - protein, 376 aa, Latrodectus hesperus
GINVDSDIGSVTSLILSGSTLQMTIPAGGDDLSGGYPGGFPAGAQPSGGAPVDFGGPSAGGDVAAKLARSLASTLASSGVFRAAFNSRVSTPVAVQLTDALVQKIASNLGLDYATASKLRKASQAVSKVRMGSDTNAYALAISSALAEVLSSSGKVADANINQIAPQLASGIVLGVSTTAPQFGVDLSSINVNLDISNVARNMQASIQGGPAPITAEGPDFGAGYPGGAPTDLSGLDMGAPSDGSHGGDATAKLLQALVPALLKSDVFRAIYKRGTRKQVVQYVTNSALQQAASSLGLDASTISQLQTKATQALSSVSADSDSTAYAKAFGLAIAQVLGTSGQVNDANVNQIGAKLATGILRGSSAVAPRLGIDLS

SEQ ID NO: 1756 - protein, 376 aa, Latrodectus hesperus
GINVDSDIGSVTSLILSGSTLQMTIPAGGDDLSGSYPGGFPAGAQPSGGAPVDFGGPSAGGDVAAKLARSLASTLASSGVFRAAFNSRVSTPVAVQLTDALVQKIASNLGLDYATASKLSKASQAVSKVRMGSDTNAYALAISSALAEVLSSSGKVADANINQIAPQLASGIVLGVSTTAPQFGVDLSSINVNLDISNVARNMQASIQGGPAPITAEGPDFGAGYPGGAPTDLSGLDMGAPSDGSRGGDATAKLLQALVPALIKSDVFRAIYKRGTRKQVVQYVTNSALQQAASSLGLDASTISQLQTKATQALSSVSADSDSTAYAKAFGLAIAQVLGTSGQVNDANVNQIGAKLATGILRGSSAVAPRLGIDLS

SEQ ID NO: 1757 - protein, 215 aa, Argiope amoena; identical to SEQ ID NO: 1281

SEQ ID NO: 1758 - protein, 215 aa, Argiope amoena; identical to SEQ ID NO: 1282

SEQ ID NO: 1759 - protein, 215 aa, Argiope amoena; identical to SEQ ID NO: 1283

SEQ ID NO: 1760 - protein, 215 aa, Argiope amoena; identical to SEQ ID NO: 1284

SEQ ID NO: 1761 - protein, 203 aa, Araneus ventricosus; identical to SEQ ID NO: 1285

SEQ ID NO: 1762 - protein, 203 aa, Araneus ventricosus; identical to SEQ ID NO: 1286

SEQ ID NO: 1763 - protein, 203 aa, Araneus ventricosus; identical to SEQ ID NO: 1288

SEQ ID NO: 1764 - protein, 203 aa, Araneus ventricosus; identical to SEQ ID NO: 1289

SEQ ID NO: 1765 - protein, 203 aa, Araneus ventricosus; identical to SEQ ID NO: 1290

SEQ ID NO: 1766 - protein, 203 aa, Araneus ventricosus; identical to SEQ ID NO: 1291

SEQ ID NO: 1767 - protein, 200 aa, Argiope trifasciata; identical to SEQ ID NO: 1293

SEQ ID NO: 1768 - protein, 200 aa, Argiope trifasciata; identical to SEQ ID NO: 1294

SEQ ID NO: 1769 - protein, 200 aa, Argiope trifasciata; identical to SEQ ID NO: 1296

SEQ ID NO: 1770 - protein, 200 aa, Argiope trifasciata; identical to SEQ ID NO: 1298

SEQ ID NO: 1771 - protein, 200 aa, Argiope trifasciata
GAGYTGPSGPSTGPSGYPGPLGGGAPFGQSGFGGSAGPQGGFGATGGASAGLISRVANALANTSTLRTVLRTGVSQQIASSVVQRAAQSLASTLGVDGNNLARFAVQAVSRLPAGSDTSAYAQAFSSALFNAGVLNASNIDTLGSRVLSALLNGVSSAAQGLGINVDSGSVQSDISSSSSFLSTSSSSASYSQALASSTS

SEQ ID NO: 1772 - protein, 189 aa, Parawixia bistriata; identical to SEQ ID NO: 1301

SEQ ID NO: 1773 - protein, 189 aa, Parawixia bistriata; identical to SEQ ID NO: 1302

SEQ ID NO: 1774 - protein, 357 aa, Uloborus diversus
GASAADIATAIAASVATSLQSNGVLTASNVSQLSNQLASYVSSGLSSTASSLGIQLGASLGAGFGASAGLSASTDISSSVEATSASTLSSSASSTSVVSSINAQLVPALAQTAVLNAAFSNINTQNAIRIAELLTQQVGRQYGLSGSDVATASSQIRSALYSVQQGSASSAYVSAIVGPLITALSSRGVVNASNSSQIASSLATAILQFTANVAPQFGISIPTSAVQSDLSTISQSLTAISSQTSSSVDSSTSAFGGISGPSGPSPYGPQPSGPTFGPGPSLSGLTGFTATFASSFKSTLASSTQFQLIAQSNLDVQTRSSLISKVLINALSSLGISASVASSIAASSSQSLLSVSA

SEQ ID NO: 1775 - protein, 171 aa, Agelenopsis aperta; identical to SEQ ID NO: 1307

SEQ ID NO: 1776 - protein, 169 aa, Agelenopsis aperta; identical to SEQ ID NO: 1308

SEQ ID NO: 1777 - protein, 164 aa, Agelenopsis aperta; identical to SEQ ID NO: 1309

SEQ ID NO: 1778 - protein, 168 aa, Agelenopsis aperta; identical to SEQ ID NO: 1310

SEQ ID NO: 1779 - protein, 168 aa, Aphonopelma seemanni; identical to SEQ ID NO: 1311

SEQ ID NO: 1780 - protein, 34 aa, Araneus bicentenarius
GGYGPGSGQQGPGQQGPGQQGPYGPGAAAAAAAA

SEQ ID NO: 1781 - protein, 34 aa, Araneus bicentenarius
GGYGPGSGQQGPVQQGPGQQGPYGPGASAAAAAA

SEQ ID NO: 1782 - protein, 39 aa, Araneus bicentenarius
GGYGPGSGQQGPGQQGPGQQGPGQQGPYGAGASAAAAAA

SEQ ID NO: 1783 - protein, 35 aa, Araneus ventricosus
GGQGGQGGYGGLGSQGAGQGGYGAGQGAAAAAAAA

SEQ ID NO: 1784 - protein, 39 aa, Araneus ventricosus
GGAGGAGRGGLGAGGAGQGYGAGLGGQGGAGQAAAAAAA

SEQ ID NO: 1785 - protein, 42 aa, Araneus ventricosus
GGAGGARQGGLGAGGAGQGYGAGLGGQGGAGQGGAAAAAAAA

SEQ ID NO: 1786 - protein, 36 aa, Araneus ventricosus
GGQGGQGGYGGLGSQGAGQGGYGAGQGGAAAAAAAA

SEQ ID NO: 1787 - protein, 38 aa, Araneus ventricosus
GGQGGQGGYGGLGSQGAGQGGYGGRQGGAGAAAAAAAA

SEQ ID NO: 1788 - protein, 42 aa, Araneus ventricosus
GGAGGAGQGGLGAGGAGQGGYGGGAYGGQGAASSAAAASAAA

SEQ ID NO: 1789 - protein, 54 aa, Argiope amoena
GGYGPGSGQRGPGSGGQGAGGQGSGQQGPGGAGQRGPGGQGPYGPGASAAAAAA

SEQ ID NO: 1790 - protein, 42 aa, Argiope amoena
GGYGPGAGQQGPGSQGPGSGGQQGPGGQGPYGPGAVAAAAAA

SEQ ID NO: 1791 - protein, 42 aa, Argiope amoena
GGYGPGAGQQGPGSQGPGSGGQQGPGGQGPYGPSAAAAAAAA

SEQ ID NO: 1792 - protein, 47 aa, Argiope amoena
GGYGPGAGQQGPGGAGQQGPGSQGPGGAGQQGPGGQGPYGPSAAAAA

SEQ ID NO: 1793 - protein, 46 aa, Argiope amoena
GSYGPRAGQQRPGAGQQGPGAGQQGPGGAGQRGPYGPGAAAAAAAA

SEQ ID NO: 1794 - protein, 42 aa, Argiope amoena
GGYGQQGPGAGQQGPGVGQQGPGGAGQRGPYGPGAAAAAAAA

SEQ ID NO: 1795 - protein, 28 aa, Argiope amoena
GGYGPRYGQQGPGAGPYGPGAGATAAAA

SEQ ID NO: 1796 - protein, 24 aa, Argiope amoena
GGYGPGAGQQGPRSQAPVASAAAA

SEQ ID NO: 1797 - protein, 49 aa, Argiope aurantia
  MOD_RES (13)..(13): Any amino acid
GGYGPGAGQQGPXGAGQQGPGSQGPGGAGQQGPGGQGPYGPGAAAAAAA

SEQ ID NO: 1798 - protein, 43 aa, Argiope aurantia
VGGYGPGAGQQGPGSQGPGSGGQQGPGGQGPYGPSAAAAAAAA

SEQ ID NO: 1799 - protein, 42 aa, Argiope aurantia
GGYGPGAGQQGPGSQGPGSGGQQGPGGLGPYGPSAAAAAAAA

SEQ ID NO: 1800 - protein, 42 aa, Argiope aurantia
GGYGPGAGQQGPGSQGPGSGGQQRPGGLGPYGPSAAAAAAAA

SEQ ID NO: 1801 - protein, 37 aa, Argiope bruennichi
GSAPQGAGGPAPQGPSQQGPVSQGPYGPGAAAAAAAA

SEQ ID NO: 1802 - protein, 56 aa, Argiope bruennichi
GGYGPGAGQQGPGSQGPGSGGQQGPGSQGPGSGGQQGPGGQGPYGPSAAAAAAAAA

SEQ ID NO: 1803 - protein, 41 aa, Argiope bruennichi
GGYGPGAGQQGPGSQGPGSGGQQGPGGQGPYGPGAAAAAAA

SEQ ID NO: 1804 - protein, 59 aa, Argiope bruennichi
GGYGPGAGQQGPGSGGQQGPGGQGPYGSGQQGPGGAGQQGPGGQGPYGPGAAAAAAAAA

SEQ ID NO: 1805 - protein, 70 aa, Argiope bruennichi
GGYGPGAGQQGPGGAGQQGPGSQGPGGQGPYGPGAGQQGPGSQGPGSGGQQGPGGQGPYGPSAAAAAAAA

SEQ ID NO: 1806 - protein, 55 aa, Argiope bruennichi
GGYGPGAGQQGPGSQGPGSGGQQGPGSQGPGSGGQQGPGGQGPYGPSAAAAAAAA

SEQ ID NO: 1807 - protein, 71 aa, Argiope bruennichi
GGYGPGAGQQGPGGAGQQGPGSQGPGGQGPYGPGAGQQGPGSQGPGSGGQQGPGGQGPYGPSAAAAAAAAA

SEQ ID NO: 1808 - protein, 59 aa, Argiope bruennichi
GGYGPGAGQRSQGPGGQGPYGPGAGQQGPGSQGPGSGGQQGPGGQGPYGPSAAAAAAAA

SEQ ID NO: 1809 - protein, 39 aa, Argiope bruennichi
GPGAGRQGPGSQGPGSGGQQGPGGQGPYGPSAAAAAAAA

SEQ ID NO: 1810 - protein, 61 aa, Argiope bruennichi
GPGARRQGPGSQGPGSGGQQGPGGQGPYGSGQQGPGGAGQQGPGGQGPYGPGAAAAAAAAA

SEQ ID NO: 1811 - protein, 53 aa, Argiope bruennichi
GGYGPGAGQQGPGGAGQQGPEGPGSQGPGSGGQQGPGGQGPYGPGAAAAAAAV

SEQ ID NO: 1812 - protein, 42 aa, Argiope bruennichi
GGYGPGAGQQGPGSQGPGSGGQQGPGGQGPYGPGAAAAAAAV

SEQ ID NO: 1813 - protein, 90 aa, Argiope bruennichi
GGYGPGAGQQGPGSGGQQGPGGQGPYGSGQQGPGGAGQQGPGGQGPYGGGYGPGAGQQGPGSQGPGSGGQQGPGGQGPYGPSAAAAAAAA

SEQ ID NO: 1814 - protein, 70 aa, Argiope bruennichi
GGYGPGAGQQGPGGAGQQGPGSQGPGGQGPYGPGAGQQGPGSQGPGSGGQQGPGSQGPYGPSAAAAAAAA

SEQ ID NO: 1815 - protein, 34 aa, Argiope bruennichi
GGQGGRGGFGGLGSQGEGGAGQGGAGAAAAAAAA

SEQ ID NO: 1816 - protein, 36 aa, Argiope bruennichi
GADGGFGLGGYGAGRGYGAGLGGAGGAGAASAAAAA

SEQ ID NO: 1817 - protein, 34 aa, Argiope bruennichi
GGQGGRSGFGGLGSQGAGGAGQGGAGAAAAAAAA

SEQ ID NO: 1818 - protein, 36 aa, Argiope bruennichi
GADGGSGLGGYGAGRGYGASLGGADGAGAASAAAAA

SEQ ID NO: 1819 - protein, 34 aa, Argiope bruennichi
GGQGGRGGFGGLGSQGAGGAGQGGAGAAAAAAAA

SEQ ID NO: 1820 - protein, 36 aa, Argiope bruennichi
SGDGGSGLGGYGAGRGYGAGLGGAGGAGAASAAAAA

SEQ ID NO: 1821 - protein, 34 aa, Argiope bruennichi
GGEGGRGGFGGLGSQGAGGAGQGGSLAAAAAAAA

SEQ ID NO: 1822 - protein, 36 aa, Argiope bruennichi
GADGGSGLGGYGAGRGYGAGLGGADGAGAASAAAAA

SEQ ID NO: 1823 - protein, 34 aa, Argiope bruennichi
GGQGGRGGFGRLGSQGAGGAGQGGAGAAAAVAAA

SEQ ID NO: 1824 - protein, 36 aa, Argiope bruennichi
GGDGGSGLGGYGAGRGYGAGLGGAGGAGAASAAAAA

SEQ ID NO: 1825 - protein, 29 aa, Argiope bruennichi
GGQGGRGGFGGLGSQGAGGAGQGGAGAAA

SEQ ID NO: 1826 - protein, 36 aa, Argiope bruennichi
SGDGGSGLGGYGAGRGYGAGLGGADGAGAASAASAA

SEQ ID NO: 1827 - protein, 34 aa, Argiope bruennichi
GGQGGRGGFGGLGSQGAGGAGQGGAGAAAAAATA

SEQ ID NO: 1828 - protein, 36 aa, Argiope bruennichi
GGDGGSGLGGYGAGRGHGVGLGGAGGAGAASAAAAA

SEQ ID NO: 1829 - protein, 36 aa, Argiope bruennichi
GGDGGSGLGGYGAGRGHGAGLGGAGGAGAASAAAAA

SEQ ID NO: 1830 - protein, 34 aa, Argiope bruennichi
GGQGGRGGFGGLGSQGSGGAGQGGSGAAAAAAAA

SEQ ID NO: 1831 - protein, 36 aa, Argiope bruennichi
GGQGGRGGFGGLGSQGAGGAGQGGSGAAAAAAAAVA

SEQ ID NO: 1832 - protein, 34 aa, Argiope bruennichi
DGGSGLGGYGAGRGYGAGLGGAGGAGAASAAAAT

SEQ ID NO: 1833 - protein, 34 aa, Argiope bruennichi
GGQGGRGGFGGLSSQGAGGAGQGGSGAAAAAAAA

SEQ ID NO: 1834 - protein, 38 aa, Argiope bruennichi
GGDGGSGLGDYGAGRGYGAGLGGAGGAGVASAAASAAA

SEQ ID NO: 1835 - protein, 34 aa, Argiope trifasciata
GGQGGQGGYDGLGSQGAGQGGYGQGGAAAAAAAA

SEQ ID NO: 1836 - protein, 43 aa, Argiope trifasciata
SGAGSAQRGGLGAGGAGQGYGAGSGGQGGAGQGGAAAATAAAA

SEQ ID NO: 1837 - protein, 34 aa, Argiope trifasciata
GGQGGQGGYGGLGSQGSGQGGYGQGGAAAAAAAA

SEQ ID NO: 1838 - protein, 43 aa, Argiope trifasciata
SGDGGAGQEGLGAGGAGQGYGAGLGGQGGAGQGGAAAAAAAAA

SEQ ID NO: 1839 - protein, 34 aa, Argiope trifasciata
GGQGGQGGYGGLGSQGAGQGGYGQGGAAAAAAAA

SEQ ID NO: 1840 - protein, 43 aa, Argiope trifasciata
SGAGGAGQGGLGAAGAGQGYGAGSGGQGGAGQGGAAAAAAAAA

SEQ ID NO: 1841 - protein, 34 aa, Argiope trifasciata
GGQGGQGGYGGLGSQGAGQGGYGQGGVAAAAAAA

SEQ ID NO: 1842 - protein, 43 aa, Argiope trifasciata
SGAGGAGRGGLGAGGAGQEYGAVSGGQGGAGQGGEAAAAAAAA

SEQ ID NO: 1843 - protein, 43 aa, Argiope trifasciata
SGAGGARRGGLGAGGAGQGYGAGLGGQGGAGQGSASAAAAAAA

SEQ ID NO: 1844 - protein, 43 aa, Argiope trifasciata
SGAGGAGRGSLGAGGAGQGYGAGLGGQGGAGQGGAAAAASAAA

SEQ ID NO: 1845 - protein, 32 aa, Argiope trifasciata
GGQGGQGGYGGLGSQGAGQGGYGQGGAAAAAA

SEQ ID NO: 1846 - protein, 46 aa, Argiope trifasciata
SAGGQGGQGGYGGLGSQGAGQGGYGGGAFSGQQGGAASVATASAAA

SEQ ID NO: 1847 - protein, 49 aa, Argiope trifasciata
GGYGPGAGQQGQQAGQGSGQQGPGGAGQGGPRGQGPYGPGAATAAAAAA

SEQ ID NO: 1848 - protein, 43 aa, Argiope trifasciata
GPGYGPGAGQQGPGSQGPGSGGQQGPGSQGPYGPSAAAAAAAA

SEQ ID NO: 1849 - protein, 43 aa, Argiope trifasciata
GPGYGPGAGQQGPGSQGPRSGGQQGPGGQGPYGPSAAAAAAAA

SEQ ID NO: 1850 - protein, 55 aa, Argiope trifasciata
GPGYGPGAGQQGPGSGGQQGGPGSGQQGPGGAGQGGPRGQGPYGPGAAAAAAAAA

SEQ ID NO: 1851 - protein, 42 aa, Argiope trifasciata
GGYGPGAGQQGPGSQGPGSGGQQGPGSQGPYGPSAAAAAAAA

SEQ ID NO: 1852 - protein, 43 aa, Argiope trifasciata
GPGYGPGAGQQGPGSQGPGSGGQQGPGGQGPYGPSAAAAAAAA

SEQ ID NO: 1853 - protein, 55 aa, Argiope trifasciata
GPGYGPGAGQQGPGSGGQQGGQGSGQQGPGGAGQGGPRGQGPYGPGAAAAAAAAA

SEQ ID NO: 1854 - protein, 54 aa, Argiope trifasciata
GPGYGPGAGQQGPGSGGQQGGQGSGQQGPGGAGQGGPRGQGPYGPGAAAAAAAA

SEQ ID NO: 1855 - protein, 43 aa, Argiope trifasciata
GPGYGPGAGQQGPGSQGPGSGGQQGPGGQGPYGPSDAAAAAAA

SEQ ID NO: 1856 - protein, 184 aa, Avicularia juruensis; identical to SEQ ID NO: 1332

SEQ ID NO: 1857 - protein, 183 aa, Avicularia juruensis
GAAAASGTAASAAATSTTTTTSTSRAAAAASAAAAASASGAADAAGAASAASAASASSSLQQSLGSALAQSSSFAAAFAQANSAASAAAIAYALAQTVANQIGFSSYSSAFASAASSAVSSLGGFASASAYAFAFASAFSQVLSNYGLLNINNAYSLASSIASAASSSASSAAAAASYSFSAT

SEQ ID NO: 1858 - protein, 177 aa, Avicularia juruensis; identical to SEQ ID NO: 1334

SEQ ID NO: 1859 - protein, 183 aa, Avicularia juruensis; identical to SEQ ID NO: 1001

SEQ ID NO: 1860 - protein, 32 aa, Deinopis spinosa
GPGGYGGPGQQGPGQGQQQGPASAAAAAAAAA

SEQ ID NO: 1861 - protein, 44 aa, Deinopis spinosa
GPGGYGGPGQQRPGQAQYGRGTGQQGQGPGAQQGPASAAAAAAA

SEQ ID NO: 1862 - protein, 34 aa, Deinopis spinosa
GAGLYGGPGQQGPGQGQQQGPASAAAAAAAAAAA

SEQ ID NO: 1863 - protein, 30 aa, Deinopis spinosa
GPGGYGGPGQQGPGQAQQQGPASAAAAAAA

SEQ ID NO: 1864 - protein, 32 aa, Deinopis spinosa
GPGGYSGPGQQGPGQAQQQGPASAAAAAAAAA

SEQ ID NO: 1865 - protein, 33 aa, Deinopis spinosa
GPGGYGGPGQQGPGQGQQQGPASAAAAAAATAA

SEQ ID NO: 1866 - protein, 46 aa, Deinopis spinosa
GPGGYGGPGQQGPGQGQYGPGTGQQGQGPSGQQGPAGAAAAAAAAA

SEQ ID NO: 1867 - protein, 46 aa, Deinopis spinosa
GPGGYGGPGQQGPGQGQYGPGAGQQGQGPGGQQGPAGAAAAAAAAA

SEQ ID NO: 1868 - protein, 30 aa, Deinopis spinosa
GPGGYGGPGQQGPGQGQQQGRAGAAAAAAA

SEQ ID NO: 1869 - protein, 25 aa, Deinopis spinosa
GPGGYGGPGQQGPGQAQQQGPAAAA

SEQ ID NO: 1870 - protein, 35 aa, Deinopis spinosa
SAGPGGYGGPGQQGPGQGQQKGPASAAAAAAATAA

SEQ ID NO: 1871 - protein, 46 aa, Deinopis spinosa
GPGGYGGPGQQGPGQGQYGPGTGQQGQGPGGQQGPASAAAAAAAAA

SEQ ID NO: 1872 - protein, 44 aa, Deinopis spinosa
GPGGYGGPGQPGPGQGQYGPGPGQQGPRQGGQQGPASAAAAAAA

SEQ ID NO: 1873 - protein, 33 aa, Deinopis spinosa
GPGGYGGPGQQGPRQGQQQGPASAAAAAAAAAA

SEQ ID NO: 1874 - protein, 31 aa, Deinopis spinosa
GPRGYGGPGQQGPVQGGQQGPASAAAAAAAA

SEQ ID NO: 1875 - protein, 47 aa, Deinopis spinosa
GVGGYGGPGQQGPGQGQYGPGTGQQGQGPSGQQGPAGAAAAAAGGAA

SEQ ID NO: 1876 - protein, 43 aa, Deinopis spinosa
GPGGYGGPGQQGPGQGQYGPGAGQQGQGPGSQQGPASAAAAAA

SEQ ID NO: 1877 - protein, 49 aa, Deinopis spinosa
GSGGYGSQGAGQGGQQGRGQGGQGQYGPGEGEQVPGQGGQGPAASAATA

SEQ ID NO: 1878 - protein, 39 aa, Deinopis spinosa
SAGGPGEYGGQQGPGQGGQQQPGQGGQGPSAAAAASAAV

SEQ ID NO: 1879 - protein, 27 aa, Deinopis spinosa
GSGGYGSQGQQGQGGQGPTASAAAAAA

SEQ ID NO: 1880 - protein, 61 aa, Deinopis spinosa
SVAGPGGYGASGQQGPRQGSQQGRFGPAAGQQGPGQTGQMGPGQQGPSGPSSAAAASAAAA

SEQ ID NO: 1881 - protein, 70 aa, Deinopis spinosa
SSGGYGSQGAGQGGQQGSGQGGPAAAGPGGYGGPGQQGPEQGQYGSGAGQQGQGPGGQQGPASAAAAAAA

SEQ ID NO: 1882 - protein, 38 aa, Deinopis spinosa
GPGRYGGPGQQGPGQGQYGPGTGQQGQGPASAAAAAAA

SEQ ID NO: 1883 - protein, 42 aa, Deinopis spinosa
GPGGYGGPGQQGPGQGRGTGQQGQGLGGQQGPDSAAAAAAAA

SEQ ID NO: 1884 - protein, 46 aa, Deinopis spinosa
GPGGYGGPGQQGPGQGQYGPGTGQQGQGPGGQQGPVGAAAAAAAAV

SEQ ID NO: 1885 - protein, 58 aa, Deinopis spinosa
SSGGYGSQGAGQGGQQGSGQRGPAAAGPGGYSGPGQQGPGQGGQQGPASAAAAAAAAA

SEQ ID NO: 1886 - protein, 41 aa, Deinopis spinosa
GPGGYVGSGQQGPGQGRGTGQQGQGTGGQQGPASAAASAAA

SEQ ID NO: 1887 - protein, 32 aa, Deinopis spinosa
GPGGYGGPGQQGPGQGGQQGPATAAAAAAAAA

SEQ ID NO: 1888 - protein, 46 aa, Deinopis spinosa
GPGGYGGPGQQGPGQGQYGPGTGQQGQGPGGQQGPAGAAATAAAAA

SEQ ID NO: 1889 - protein, 44 aa, Deinopis spinosa
GPGGYGGPGQQGPEQGQYRPGAGQQGQGPGGQQGPASAAAAAAA

SEQ ID NO: 1890 - protein, 38 aa, Deinopis spinosa
GPGGYGGPGQQGPGRGQYGPGTGQQGQGPASAAAAAAA

SEQ ID NO: 1891 - protein, 41 aa, Deinopis spinosa
GPGGYGGPGQQGPGQGRGTGQQGQGLGGQQGPDSAAAAAAA

SEQ ID NO: 1892 - protein, 41 aa, Deinopis spinosa
GPGGYGGSGQQGPGQGRGTGQQGQGPGGQQGPASAAAAAAA

SEQ ID NO: 1893 - protein, 38 aa, Deinopis spinosa
GPGGYGGPGQQGPGQGQYGPGTGQQGQGPASAAAAAAA

SEQ ID NO: 1894 - protein, 46 aa, Deinopis spinosa
GPGGYGGPGQQGPGQGQYGPGTGQQGQGPGGQQGPGGASAAAAAAA

SEQ ID NO: 1895 - protein, 39 aa, Diguetia canities
GTGGVGGLFLSSGDFGRGGAGAGAGAAAASAAAASSAAA

SEQ ID NO: 1896 - protein, 39 aa, Diguetia canities
GARGGSGFGVGTGGFGRGGAGAGTGAAAASAAAASAAAA

SEQ ID NO: 1897 - protein, 39 aa, Diguetia canities
GAGGDGGLFLSSGDFGRGGAGAGAGAAAASAAAASSAAA

SEQ ID NO: 1898 - protein, 39 aa, Diguetia canities
GARGGSGFGVGTGGFGRGGAGDGASAAAASAAAASAAAA

SEQ ID NO: 1899 - protein, 39 aa, Diguetia canities
GAGGDSGLFLSSGDFGRGGAGAGAGAAAASAAAASAAAA

SEQ ID NO: 1900 - protein, 39 aa, Diguetia canities
GARGGSGFGVGTGGFGRGGPGAGTGAAAASAAAASAAAA

SEQ ID NO: 1901 - protein, 39 aa, Diguetia canities
GAGGDSGLFLSSEDFGRGGAGAGTGAAAASAAAASAAAA

SEQ ID NO: 1902 - protein, 39 aa, Diguetia canities
GAGGDSGLFLSSGDFGRGGAGAGAGAAAASAAAASAASA

SEQ ID NO: 1903 - protein, 40 aa, Diguetia canities
GAGRGTGFGERILIGGSRGFGGARVDAPAASTASASAAAA

SEQ ID NO: 1904 - protein, 19 aa, Diguetia canities
GSGAGQAAGTGAAAAAAAA

SEQ ID NO: 1905 - protein, 56 aa, Diguetia canities
GASGAGPSVSYEITQAFGGSGAGAASAAAAAAAAANAAAAQQQQAAATAAAAAAAA

SEQ ID NO: 1906 - protein, 22 aa, Diguetia canities
GSGAGQGTGAGAGAAAAAAGAA

SEQ ID NO: 1907 - protein, 24 aa, Diguetia canities
GSGAGQGAGSGAGAAAAAAAASAA

SEQ ID NO: 1908 - protein, 22 aa, Diguetia canities
GAGQGAGSGSGAGAAAAAAAAA

SEQ ID NO: 1909 - protein, 25 aa, Diguetia canities
GAGQGAGSGSGAGAAAAAAAAAAAA

SEQ ID NO: 1910 - protein, 20 aa, Diguetia canities
QQQQQQQAAAAAAAAAAAAA

SEQ ID NO: 1911 - protein, 36 aa, Diguetia canities
GSGQGASFGVTQQFGAPSGAASSAAAAAAAAAAAAA

SEQ ID NO: 1912 - protein, 21 aa, Diguetia canities
GSGAGQEAGTGAGAAAAAAAA

SEQ ID NO: 1913 - protein, 25 aa, Diguetia canities
GAAGSGAGQGAGSGAGAAAAAAAAA

SEQ ID NO: 1914 - protein, 28 aa, Diguetia canities
SAAGAGQGAGSGSGAGAAAAAAAAAAAA

SEQ ID NO: 1915 - protein, 32 aa, Diguetia canities
GSGQGASFGISQQFGAPSGAASSAAAAAAAAA

SEQ ID NO: 1916 - protein, 51 aa, Dolomedes tenebrosus
GGAGQSGSGPYGASYLSSTTYTTSSQGAGGGVGGYGQGSGTGSAAAAAGAA

SEQ ID NO: 1917 - protein, 38 aa, Dolomedes tenebrosus
GAGQGGQGGYGQGAGQGGLGGYGQGGGAGAAAAAAAAA

SEQ ID NO: 1918 - protein, 33 aa, Dolomedes tenebrosus
GGAGSGQGGYGGQGGLGGYGQGAGAGAAAAAAA

SEQ ID NO: 1919 - protein, 34 aa, Dolomedes tenebrosus
GGAGAGQGGFGGQGGYGQGGGAGAAAAAAAAAAA

SEQ ID NO: 1920 - protein, 31 aa, Dolomedes tenebrosus
GGAGAGQGSYGGQGGYGQGGAGAATATAAAA

SEQ ID NO: 1921 - protein, 35 aa, Dolomedes tenebrosus
GGAGSGQGGYGGQGGLGGYGQGAGAGAAAAAAAAA

SEQ ID NO: 1922 - protein, 32 aa, Dolomedes tenebrosus
GGAGAGQGGYGGQGGQGGYGQGAGAGAAAAAA

SEQ ID NO: 1923 - protein, 31 aa, Dolomedes tenebrosus
GGAGAGQGGYGGQGGYGQGGGAGAAAAAAAA

SEQ ID NO: 1924 - protein, 37 aa, Dolomedes tenebrosus
SGGSGSGQGGYGGQGGLGGYGQGAGAGAGAAASAAAA

SEQ ID NO: 1925 - protein, 59 aa, Dolomedes tenebrosus
GAGSGQGGYGGQGGLGGYGQGAGAGAAAGASGSGSGGAGQGGLGGYGQGAGAGAAAAAA

SEQ ID NO: 1926 - protein, 51 aa, Dolomedes tenebrosus
GASGAGQGGFGPYGSSYQSSTSYSVTSQGAAGGLGGYGQGSGAGAAAAGAA

SEQ ID NO: 1927 - protein, 42 aa, Dolomedes tenebrosus
GQGGQGGYGQGAGAGAGAGAGQGGLGGYGQGAGSSAASAAAA

SEQ ID NO: 1928 - protein, 24 aa, Euprosthenops australis
GQGGPGGYGPAPNQGASSAAAAAA

SEQ ID NO: 1929 - protein, 41 aa, Euprosthenops australis
GSGQGPSGPYGTSYQISTQYTQTTTSQGQGYGSSSAGAAAA

SEQ ID NO: 1930 - protein, 39 aa, Euprosthenops australis
GAAGAGQGGYGGQGQGGYGQGAGGAAAAAAAAAAAAAAA

SEQ ID NO: 1931 - protein, 47 aa, Euprosthenops australis
GQGGQGGGGYGQGGQGGQGGQGQGGYGQGAGSSAAAAAAAAAAAAAA

SEQ ID NO: 1932 - protein, 18 aa, Euprosthenops australis
GRGQGGYGQGSGGAAAAA

SEQ ID NO: 1933 - protein, 21 aa, Euprosthenops australis
GSGQGGYGGRRQGGYGQAAAA

SEQ ID NO: 1934 - protein, 37 aa, Euprosthenops australis
GQGGQGGYGGLGQGGYGQGAGSSAAAAAAAAAAAAAA

SEQ ID NO: 1935 - protein, 26 aa, Euprosthenops australis
GRGQGGYGQGSGGNAAAAAAAAAAAA

SEQ ID NO: 1936 - protein, 38 aa, Euprosthenops australis
SGQGGQGGQGGQGQGGYGQGAGSSAAAAAAAAAAAAAA

SEQ ID NO: 1937 - protein, 27 aa, Euprosthenops australis
GQGQGRYGQGAGGNAAAAAAAAAAAAA

SEQ ID NO: 1938 - protein, 36 aa, Euprosthenops australis
GQGGQGGQGGLGQGGYGQGAGSSAAAAAASAAAAAA

SEQ ID NO: 1939 - protein, 28 aa, Euprosthenops australis
GRGQGGYGQGAGGNAAAAAAAAAAAAAA

SEQ ID NO: 1940 - protein, 36 aa, Euprosthenops australis
GQGGQGGYGGLGQGGYGQGAGSSAAAAAAAAAAAAA

SEQ ID NO: 1941 - protein, 32 aa, Euprosthenops australis
GGQGGQGQGRYGQGAGSSAAAAAAAAAAAAAA

SEQ ID NO: 1942 - protein, 27 aa, Euprosthenops australis
GQGQGGYGQGAGGNAAAAAAAAAAAAA

SEQ ID NO: 1943 - protein, 36 aa, Euprosthenops australis
GQGGQGGQGGLGQGGYGQGAGSSAAAAAAAAAAAAA

SEQ ID NO: 1944 - protein, 28 aa, Euprosthenops australis
GRGQGGYGQGAGGNAAAAAAAAAEAAAA

SEQ ID NO: 1945 - protein, 37 aa, Euprosthenops australis
SGQGSQGGQGGQGQGGYGQGAGSSAAAAAAAAAAAAA

SEQ ID NO: 1946 - protein, 29 aa, Euprosthenops australis
SGRGQGGYGQGAGGNAAAAAAAAAAAAAA

SEQ ID NO: 1947 - protein, 35 aa, Euprosthenops australis
GQGGQGGYGGLGQGGYGQGAGSSAAAAAAAAAAAA

SEQ ID NO: 1948 - protein, 32 aa, Euprosthenops australis
GGQGGQGQGGYGQGAGSSAAAAAAAAAAAAAA

SEQ ID NO: 1949 - protein, 37 aa, Euprosthenops australis
GQGGQGGQGGLGQGGYGQGAGSSAAAAAAAAAAAAAA

SEQ ID NO: 1950 - protein, 27 aa, Euprosthenops australis
GRGQGGYGQGVGGNAAAAAAAAAAAAA

SEQ ID NO: 1951 - protein, 33 aa, Euprosthenops australis
GGQGGQGQGGYGQGSGGSAAAAAAAAAAAAAAA

SEQ ID NO: 1952 - protein, 28 aa, Euprosthenops australis
GRGQGGYGQGSGGNAAAAAAAAAAAAAA

SEQ ID NO: 1953 - protein, 31 aa, Euprosthenops australis
GQGGQGGYGRQSQGAGSAAAAAAAAAAAAAA

SEQ ID NO: 1954 - protein, 29 aa, Euprosthenops australis
GSGQGGYGGQGQGGYGQSSASASAAASAA

SEQ ID NO: 1955 - protein, 32 aa, Euprosthenops australis
GGQGGFSGQGQGGFGPGAGSSAAAAAAAAAAA

SEQ ID NO: 1956 - protein, 31 aa, Euprosthenops australis
RQGGQGQGGFGQGAGGNAAAAAAAAAAAAAA

SEQ ID NO: 1957 - protein, 29 aa, Euprosthenops australis
QQGGQGGFSGRGQGGFGPGAGSSAAAAAA

SEQ ID NO: 1958 - protein, 32 aa, Euprosthenops australis
GQGGQGQGGFGQGAGGNAAAAAAAAAAAAAAA

SEQ ID NO: 1959 - protein, 32 aa, Euprosthenops australis
GQGGQGRGGFGQGAGGNAAAAAAAAAAAAAAA

SEQ ID NO: 1960 - protein, 29 aa, Euprosthenops australis
QQGGQGGFGGRGQGGFGPGAGSSAAAAAA

SEQ ID NO: 1961 - protein, 32 aa, Euprosthenops australis
GQGGQGRGGFGQGAGGNAAAASAAAAASAAAA

SEQ ID NO: 1962 - protein, 31 aa, Euprosthenops australis
GQGGQGRGGFGQGAGGNAAAAAAAAAAAAAA

SEQ ID NO: 1963 - protein, 34 aa, Euprosthenops australis
QQVGQFGFGGRGQGGFGPFAGSSAAAAAAASAAA

SEQ ID NO: 1964 - protein, 29 aa, Euprosthenops australis
GQGGQGQGGFGQGAGGNAAAAAAAAAAAA

SEQ ID NO: 1965 - protein, 32 aa, Euprosthenops australis
RQGGQGQGGFSQGAGGNAAAAAAAAAAAAAAA

SEQ ID NO: 1966 - protein, 34 aa, Euprosthenops australis
QQGGQGGFGGRGQGGFGPGAGSSAAAAAAATAAA

SEQ ID NO: 1967 - protein, 32 aa, Euprosthenops australis
GQGGQGRGGFGQGAGSNAAAAAAAAAAAAAAA

SEQ ID NO: 1968 - protein, 31 aa, Euprosthenops australis
GQGGQGQGGFGQGTVGNAAAAAAAAAAAAAA

SEQ ID NO: 1969 - protein, 31 aa, Euprosthenops australis
QQGGQGGFGGQGQRGFGQRAASAVASAASAA

SEQ ID NO: 1970 - protein, 34 aa, Euprosthenops australis
GQGGQGGYGGLGQGGYGQGAGSSAAAAAAAAAAA

SEQ ID NO: 1971 - protein, 39 aa, Euprosthenops australis
SGQGGQGGQGGQGQGGYGQGAGSSAAAAAAAAAAAAAAA

SEQ ID NO: 1972 - protein, 26 aa, Euprosthenops australis
GRGQGGYGQGAGGNAAAAAAAAAAAA

SEQ ID NO: 1973 - protein, 21 aa, Euprosthenops australis
GRGQGGYGQGSGGNAAAAAAA

SEQ ID NO: 1974 - protein, 29 aa, Euprosthenops australis
GQGGFGGQEGNGQGAGSAAAAAAAAAAAA

SEQ ID NO: 1975 - protein, 35 aa, Euprosthenops australis
GGSGQGRYGGRGQGGYGQGAGAAASAAAAAAAAAA

SEQ ID NO: 1976 - protein, 35 aa, Euprosthenops australis
GGSGQGGYGGRGQGGYGQGAGAAAAAAAAAAAAAA

SEQ ID NO: 1977 - protein, 30 aa, Euprosthenops australis
GQGGQGGFGSQGGNGQGAGSAAAAAAAAAA

SEQ ID NO: 1978 - protein, 35 aa, Euprosthenops australis
GESGQGGYGGRGQGGYGQGAGAAAAAAVAAAAAAA

SEQ ID NO: 1979 - protein, 42 aa, Gasteracantha mammosa
GGYRPVSGQQGPGQQGPGSGGQQGPGGQRPYGPGAAAAAAAA

SEQ ID NO: 1980 - protein, 43 aa, Gasteracantha mammosa
GGYGPGSGQGGPGQQGPGSGGQQGPGGQGPYGPGAAAAAAAAA

SEQ ID NO: 1981 - protein, 45 aa, Gasteracantha mammosa
GGYGPGSGQGGQQGPGSQGPGSGGQQGPGGQGPYGPSAAAAAAAV

SEQ ID NO: 1982 - protein, 43 aa, Gasteracantha mammosa
GGYGPGAGQQGPGQQGPGSGGQRGPGGQGPYGPGAAAAAAAAA

SEQ ID NO: 1983 - protein, 41 aa, Gasteracantha mammosa
GGYGPASGQQGPGQQGPGSGGQRGPGGQGPYGPGAAAAASA

SEQ ID NO: 1984 - protein, 35 aa, Hypochilus thorelli
GASGAGQGQGYGQQGQGGSSAAAAAAAAAAAAAAA

SEQ ID NO: 1985 - protein, 24 aa, Hypochilus thorelli
QGQGQGYGQQGQGSAAAAAAAAAA

SEQ ID NO: 1986 - protein, 28 aa, Hypochilus thorelli
GASGAGQGQGYGQQGQGSAAAAAAAAAA

SEQ ID NO: 1987 - protein, 36 aa, Hypochilus thorelli
GASGAGQGQGYGQQGQGGSSAAAAAAAAAAAAAAAA

SEQ ID NO: 1988 - protein, 21 aa, Hypochilus thorelli
QGQGYGQQGQGSAAAAAAAAA

SEQ ID NO: 1989 - protein, 31 aa, Hypochilus thorelli
GASGAGQGQGYGQQGQGGSSAAAAAAAAAAA

SEQ ID NO: 1990 - protein, 36 aa, Hypochilus thorelli
QGQGQGYGQQGQGYGQQGQGGSSAAAAAAAAAAAAA

SEQ ID NO: 1991 - protein, 23 aa, Hypochilus thorelli
QGQGQGYGQQGQGSAAAAAAAAA

SEQ ID NO: 1992 - protein, 25 aa, Hypochilus thorelli
QGQGYGQQGQGSAAAAAAAAAAAAA

SEQ ID NO: 1993 - protein, 132 aa, Hypochilus thorelli
GFGFGQSGSFAASSASSVSFAQALASSLVNSADFVSFCNSGVSPASIFPILRATAISLGYDETFASTVASAVAQSTATVGAGASASAYAQAWSTAIAGNLLSYGYLTGGNASAVASSFASALLFNVSSAAAA

SEQ ID NO: 1994 - protein, 133 aa, Hypochilus thorelli
GLASGQLGSFVTAGSSSVSFAQAFSSSLVNSADFVSFCNSGVSPASIFPILRATAISLGYDETFASTVASAVAQSTATVGAGASASAYAQAWSTAIAGNLLNYGYLTGGNASAIASSFASALLFNVSSAAASA

SEQ ID NO: 1995 - protein, 104 aa, Hypochilus thorelli
GASAAAISRARAAAASGASAGAATGASAGAASGASVAAASRARAAAASGGSAGAASGASAGAASGASAGAASGASAGAAGSASAGAASGASAAAASRARAAATS

SEQ ID NO: 1996 - protein, 32 aa, Hypochilus thorelli
VAGASAVSGASAGAASGASAAAASRARAAAAS

SEQ ID NO: 1997 - protein, 32 aa, Hypochilus thorelli
VAGAGAISGASAGAASGASAAAASRARTAAAS

SEQ ID NO: 1998 - protein, 182 aa, Kukulcania hibernalis; identical to SEQ ID NO: 1359

SEQ ID NO: 1999 - protein, 182 aa, Kukulcania hibernalis; identical to SEQ ID NO: 1360

SEQ ID NO: 2000 - protein, 188 aa, Kukulcania hibernalis
GEAFSASSASSAVVFESAGPGEEAGSSGGGASAAASAAAAAGAGSGRRGPGGARSRGGAGAGAGAGSGVGGYGSGSGAGAGAGAGAGAGGEGGFGEGQGYGAGAGAGAGAGAGFGSGAGAGAGAGSGAGAGEGVGSGAGAGAGAGFGVGAGAGAGAGAGFGSGAGAGSGAGAGYGAGRAGGRGRGGRG

SEQ ID NO: 2001 - protein, 365 aa, Megahexura fulva
GSYAYAQAAAGAFANVLFQAGVLTYANASALASAYASAYASSVASAAASASAGASASSGASASASAAAAAAAAAAASASAGASASAGASASAGASASASASATASAFASAFASAVVQTGYFSNVFGNVYSAAQASYYASASAQAAASAAGFGSSVANAVASASASAAGGVSVGAGAQAYASALGNGLGQALLANGVLNSGNYLQLANSLAYSFGSSLSQYSSSAAGASAAGAASGAAGAGAGAASSGGSSGSASSSTTTTTTTSTSAAAAAAAAAAAASAAASTSASASASASASASAFSQTFVQTVLQSAAFGSYFGGNLSLQSAQAAASAAAQAAAQQIGLGSYGYALANAVASAFASAGANA

SEQ ID NO: 2002 - protein, 364 aa, Megahexura fulva
GSYAYAQAAAGAFANVLFQAGVLTYANASALASAYASAYASSVASAAASASAGASASSGASASASAAAAAAAAAAASASAGASASAGASASAGASASASASATASAFASAFASAVVQTGYFSNVFGNVYSAAQASYYASASAQAAASAAGFGSSVANAVASASASAAGGVSVGAGAQAYASALGNGLGQALLANGVLNSGNYLQLANSLAYSFGSSLSQYSSSAAGASAAGAASGAAGAGAGAASSGGSSGSASSSTTTTTTTSTSAAAAAAAAAAASAAASTSASASASASASASAFSQTFVQTVLQSAAFGSYFGGNLSLQSAQAAASAAAQAAAQQIGLGSYGYALANAVASAFASAGANA

SEQ ID NO: 2003 - protein, 164 aa, Megahexura fulva
GSASSSTTTTTTTSTSAAAAAAAAAAASAAASTSASASASASASASAFSQTFVQTVLQSAAFGSYFGGNLSLQSAQAAASAAAQAAAQQIGLGSYGYALANAVASAFASAGANAGSYAYAQAAAGAFATVLFQAGVLTYANASALASAYASAYASSVASAAASA

SEQ ID NO: 2004 - protein, 194 aa, Megahexura fulva
SAGASASSGASASASAAAAAAAAAAASASAGASASAGASASASASATASAFASAFASAVVQTGYFSNVFGNVYSAAQASYYASASAQAAASAAGFGSSVANAVASASASAAGGVSVGAGAQAYASALGNGLGQALLANGVLNSGNYLQLANSLAYSFGSSLSQYSSSAAGASAAGAASGAAGAGAGAASSGGSS

SEQ ID NO: 2005 - protein, 164 aa, Megahexura fulva
GSSSSSTTTTTTTSASAAAAAAAAASAAASTSASASASASASASAFSQTFSQTVLQSASYGSYFGGSLSLQSAQAAASAAAQAAALQIGLGSYGNALASAVGSAVGSAGANAGAYGFTQAAASAVASVLLQAGVLNYGNATALASAYASAYASSVASAAASASA

SEQ ID NO: 2006 - protein, 36 aa, Nephila clavata
GAGAGGYGPGQQGPGGYGPSGPSGPGGASAAAAAAA

SEQ ID NO: 2007 - protein, 44 aa, Nephila clavata
GPGGYGPGQQGPGQQGPGQQGPAGYGPSGPSGPGGAAAAAAAAA

SEQ ID NO: 2008 - protein, 42 aa, Nephila clavata
GPGGYGLGQQGPGQQGPGQQGPAGYGPSGLSGPGGAAAAAAA

SEQ ID NO: 2009 - protein, 25 aa, Nephila clavata
GPGGYGPGQQRPSGPGGAAAAAAAA

SEQ ID NO: 2010 - protein, 23 aa, Nephila clavata
GPGGYGPSQRGPSGPGSAAAAAA

SEQ ID NO: 2011 - protein, 26 aa, Nephila clavata
GAGPGGYGPGQKGPSGPGSAAAAAAA

SEQ ID NO: 2012 - protein, 28 aa, Nephila clavata
GPGGYGPSQQGPARYGPSGPGSAAAAAA

SEQ ID NO: 2013 - protein, 41 aa, Nephila clavipes
GGAGQGGYGGLGGQGAGQGGYGGLGGQGAGQGAGAAAAAAA

SEQ ID NO: 2014 - protein, 30 aa, Nephila clavipes
GGAGQGGYGGLGSQGAGRGGQGAGAAAAAA

SEQ ID NO: 2015 - protein, 34 aa, Nephila clavipes
GGAGQGGYGGLGSQGAGRGGLGGQGAGAAAAAAA

SEQ ID NO: 2016 - protein, 28 aa, Nephila clavipes
GGAGQGGYGGLGNQGAGRGGQGAAAAAA

SEQ ID NO: 2017 - protein, 33 aa, Nephila clavipes
GGAGQGGYGGLGSQGAGRGGLGGQGAGAAAAAA

SEQ ID NO: 2018 - protein, 47 aa, Nephila clavipes
GGAGQGGYGGLGGQGAGQGGYGGLGSQGAGRGGLGGQGAGAAAAAAA

SEQ ID NO: 2019 - protein, 24 aa, Nephila clavipes
GGAGQGGLGGQGAGQGAGASAAAA

SEQ ID NO: 2020 - protein, 30 aa, Nephila clavipes
GGAGQGGYGGLGSQGAGRGGEGAGAAAAAA

SEQ ID NO: 2021 - protein, 44 aa, Nephila clavipes
GGAGQGGYGGLGGQGAGQGGYGGLGSQGAGRGGLGGQGAGAAAA

SEQ ID NO: 2022 - protein, 24 aa, Nephila clavipes
GGAGQGGLGGQGAGQGAGAAAAAA

SEQ ID NO: 2023 - protein, 34 aa, Nephila clavipes
GGAGQGGYGGLGSQGAGRGGLGGQGAGAVAAAAA

SEQ ID NO: 2024 - protein, 34 aa, Nephila clavipes
GGAGQRGYGGLGNQGAGRGGLGGQGAGAAAAAAA

SEQ ID NO: 2025 - protein, 27 aa, Nephila clavipes
GGAGQGGYGGLGNQGAGRGGQGAAAAA

SEQ ID NO: 2026 - protein, 31 aa, Nephila clavipes
GGAGQGGYGGLGSQGAGRGGQGAGAAAAAAV

SEQ ID NO: 2027 - protein, 42 aa, Nephila clavipes
GAGQEGIRGQGAGQGGYGGLGSQGSGRGGLGGQGAGAAAAAA

SEQ ID NO: 2028 - protein, 27 aa, Nephila clavipes
GGAGQGGLGGQGAGQGAGAAAAAAGGV

SEQ ID NO: 2029 - protein, 27 aa, Nephila clavipes
RQGGYGGLGSQGAGRGGQGAGAAAAAA

SEQ ID NO: 2030 - protein, 31 aa, Nephila clavipes
GGAGQGGYGGLGGQGVGRGGLGGQGAGAAAA

SEQ ID NO: 2031 - protein, 22 aa, Nephila clavipes
GGAGQGGYGGVGSGASAASAAA

SEQ ID NO: 2032 - protein, 24 aa, Nephila clavipes
GGYGQGPSGYGPGASASSAAAAAA

SEQ ID NO: 2033 - protein, 22 aa, Nephila clavipes
PSGYGPSQQGPSGSAAAAAAAA

SEQ ID NO: 2034 - protein, 21 aa, Nephila clavipes
PSGYGPRQQAPSGPAAAAAAA

SEQ ID NO: 2035 - protein, 28 aa, Nephila clavipes
GAGGYGPAQRGPSVYGPSGPGAAAAAAA

SEQ ID NO: 2036 - protein, 43 aa, Nephila clavipes
GPGGYGPGQQGPGGYGPGQQGPGRYGPGQQGPSGPGSAAAAAA

SEQ ID NO: 2037 - protein, 42 aa, Nephila clavipes
GSGQQGPGGYGPRQQGPGGYGQGQQGPSGPGSAAAASAAASA

SEQ ID NO: 2038 - protein, 50 aa, Nephila clavipes
ESGQQGPGGYGPGQQGPGGYGPGQQGPGGYGPGQQGPSGPGSAAAAAAAA

SEQ ID NO: 2039 - protein, 41 aa, Nephila clavipes
SGPGQQGPGGYGPGQQGPGGYGPGQQGPSGPGSAAAAAAAA

SEQ ID NO: 2040 - protein, 40 aa, Nephila clavipes
SGPGQQGPGGYGPGQQGPGGYGPGQQGLSGPGSAAAAAAA

SEQ ID NO: 2041 - protein, 31 aa, Nephila clavipes
GPGQQGPGGYGPGQQGPSGPGSAAAAAAAAA

SEQ ID NO: 2042 - protein, 34 aa, Nephila clavipes
GPGGYGPGQQGPGGYGPGQQGPSGAGSAAAAAAA

SEQ ID NO: 2043 - protein, 42 aa, Nephila clavipes
GPGQQGLGGYGPGQQGPGGYGPGQQGPGGYGPGSASAAAAAA

SEQ ID NO: 2044 - protein, 32 aa, Nephila clavipes
GPGQQGPGGYGPGQQGPSGPGSASAAAAAAAA

SEQ ID NO: 2045 - protein, 37 aa, Nephila clavipes
GPGGYGPGQQGPGGYAPGQQGPSGPGSASAAAAAAAA

SEQ ID NO: 2046 - protein, 36 aa, Nephila clavipes
GPGGYGPGQQGPGGYAPGQQGPSGPGSAAAAAAAAA

SEQ ID NO: 2047 - protein, 21 aa, Nephila madagascariensis
GRGPEGYGPRQQGPGATAAAA

SEQ ID NO: 2048 - protein, 30 aa, Nephila madagascariensis
GPGGYGPRQQGPGGYGPGQQGPGAAAAAAA

SEQ ID NO: 2049 - protein, 24 aa, Nephila madagascariensis
GRGPGGYGPGQQGPGGPGAAAAAA

SEQ ID NO: 2050 - protein, 20 aa, Nephila madagascariensis
GSEGYGPGQQGPRGPGAAAA

SEQ ID NO: 2051 - protein, 20 aa, Nephila madagascariensis
GPGGYGPGQQGASAAASAAA

SEQ ID NO: 2052 - protein, 22 aa, Nephila madagascariensis
GRGPGGYGPGQQGPGGPSAAAA

SEQ ID NO: 2053 - protein, 20 aa, Nephila madagascariensis
GPGGYGPGQQGPSAAAAAAA

SEQ ID NO: 2054 - protein, 24 aa, Nephila madagascariensis
GSGPGGYGPGQQGPGGPGAAAAAA

SEQ ID NO: 2055 - protein, 27 aa, Nephila madagascariensis
GPGGYGPGQQGPGAAAAAAGQAAAAAA

SEQ ID NO: 2056 - protein, 28 aa, Nephila madagascariensis
GPGGYGPGGYGPGQQGPGGPGAAAAAAA

SEQ ID NO: 2057 - protein, 29 aa, Nephila madagascariensis
GRGPGGYGPGQQGPGQQGPGGSGAAAAAA

SEQ ID NO: 2058 - protein, 21 aa, Nephila madagascariensis
GPGGYGPGQQGPGAAAAAAAA

SEQ ID NO: 2059 - protein, 25 aa, Nephila madagascariensis
GRGPGGYGPGQQGPGGPGAAAAAAA

SEQ ID NO: 2060 - protein, 24 aa, Nephila madagascariensis
GRGPGGYGPGQQGPGGSGAAAAAA

SEQ ID NO: 2061 - protein, 20 aa, Nephila madagascariensis
GPGGYGPGQQGTGAAAAAAA

SEQ ID NO: 2062 - protein, 24 aa, Nephila madagascariensis
GSGAGGYGPGQQGPGGPGAAAAAA

SEQ ID NO: 2063 - protein, 20 aa, Nephila madagascariensis
GPGGYGPGQQGPGAAAAAAA

SEQ ID NO: 2064 - protein, 24 aa, Nephila madagascariensis
GSGPGGYGPGQQGPGGSSAAAAAA

SEQ ID NO: 2065 - protein, 18 aa, Nephila madagascariensis
GPGRYGPGQQGPGAAAAA

SEQ ID NO: 2066 - protein, 26 aa, Nephila madagascariensis
SAGRGPGGYGPGQQGPGGPGAAAAAA

SEQ ID NO: 2067 - protein, 25 aa, Nephila madagascariensis
GSGPGGYGPGQQGPGGPGAAAAAAA

SEQ ID NO: 2068 - protein, 24 aa, Nephila madagascariensis
GRGPGGYGQGQQGPGGPGAAAAAA

SEQ ID NO: 2069 - protein, 26 aa, Nephila madagascariensis
GSGPGGYGPGQQGPGRSGAAAAAAAA

SEQ ID NO: 2070 - protein, 18 aa, Nephila madagascariensis
GPGGYGPGQQGPGAAAAA

SEQ ID NO: 2071 - protein, 26 aa, Nephila madagascariensis
SAGRGPGGYGPGQQGPGGSGAAAAAA

SEQ ID NO: 2072 - protein, 27 aa, Nephila madagascariensis
GPGGYGPGQQRPGQQGPGGPGAAAAAA

SEQ ID NO: 2073 - protein, 29 aa, Nephila madagascariensis
GRGPGGYGPGQQGPGQQGPGGPGAAAAAA

SEQ ID NO: 2074 - protein, 20 aa, Nephila madagascariensis
GPGRYGPGQQGPGAAAAAAA

SEQ ID NO: 2075 - protein, 26 aa, Nephila madagascariensis
GSGPGGYGPGQQGPGGPGAAAAAAAA

SEQ ID NO: 2076 - protein, 20 aa, Nephila madagascariensis
GPGGYGPGQQGPGAAAAASA

SEQ ID NO: 2077 - protein, 24 aa, Nephila madagascariensis
GTGPGGYGPGQQGPGGSGAAAAAA

SEQ ID NO: 2078 - protein, 23 aa, Nephila madagascariensis
GRGPGGYGPGQQGPGGSGAAAAA

SEQ ID NO: 2079 - protein, 29 aa, Nephila madagascariensis
SGRGPGGSGPGGYGPGQQGPGAAAAAAAA

SEQ ID NO: 2080 - protein, 19 aa, Nephila madagascariensis
GPGGYGPGQQGPGAAAAAA

SEQ ID NO: 2081 - protein, 24 aa, Nephila madagascariensis
PSGYVPSQTGQSGLGAAAAAAAVA

SEQ ID NO: 2082 - protein, 22 aa, Nephila madagascariensis
PSGYGPSQQGPSGPGAATAAAA

SEQ ID NO: 2083 - protein, 21 aa, Nephila madagascariensis
GSYGQGPSGYAQGSSAASAAA

SEQ ID NO: 2084 - protein, 24 aa, Nephila madagascariensis
GRGPGGYGPGQQGPGGSGAAAAAS

SEQ ID NO: 2085 - protein, 42 aa, Nephila madagascariensis
GPGQQGPGGYGPGQQGPGGYGPGQQGPSGPGSAAAAAAAAAA

SEQ ID NO: 2086 - protein, 50 aa, Nephila madagascariensis
GPGQQGPGGYGPGPQGPGGYGPGQQGPSGYGPGQQGPSGPGSAASAAAAA

SEQ ID NO: 2087 - protein, 39 aa, Nephila madagascariensis
GSGQQGPGGYGPGQQGPGGYGPGQQGPSGPGSAAAAAAA

SEQ ID NO: 2088 - protein, 40 aa, Nephila madagascariensis
GPGQQGPGGYGPGQQGPGGYGPGQQGPSGPGSAAAAAAAA

SEQ ID NO: 2089 - protein, 39 aa, Nephila madagascariensis
GPGQQGPGGYGPGQQGPGGYGPGQQGPSGPGSAAAAAAA

SEQ ID NO: 2090 - protein, 41 aa, Nephila madagascariensis
GPGQQGPGGYGPGQQGPGGYGPGQQGPSGPGSAAAAAAAAA

SEQ ID NO: 2091 - protein, 34 aa, Nephila madagascariensis
GPGQQGPGGYGPGQQGPGQQGPSGPGSAAAAAAA

SEQ ID NO: 2092 - protein, 35 aa, Nephila madagascariensis
GPGPQGPGGYGPGQQGPGGYGPSGPGSAAAAAAAA

SEQ ID NO: 2093 - protein, 39 aa, Nephila madagascariensis
GPGQQGPGGYGPGQQRPSGYGPGQQGPSGPGSAAAAAAA

SEQ ID NO: 2094 - protein, 22 aa, Nephila madagascariensis
GPGQQGPGAYGPSGPGSAAAAA

SEQ ID NO: 2095 - protein, 24 aa, Nephila madagascariensis
GLGGYGPAQQGPSGAGSAAAAAAA

SEQ ID NO: 2096 - protein, 34 aa, Nephila madagascariensis
GGAGQGGYGGLGSQGAGRGGYGGQGAGAAAAAAA

SEQ ID NO: 2097 - protein, 39 aa, Nephila madagascariensis
GGAGQGGYGGLGSQGAGQGGYGGLGGQGAGQGAAAAAAA

SEQ ID NO: 2098 - protein, 32 aa, Nephila madagascariensis
GGAGQGGYGGLGSQGAGRGGYGGQGAGAAAAA

SEQ ID NO: 2099 - protein, 44 aa, Nephila pilipes
GGAGQGGYGGLGGQGSGAAASGAGQGGYGGLGGQGAGAAAAAAA

SEQ ID NO: 2100 - protein, 43 aa, Nephila pilipes
GGAGQGGYGGLGGQGAGAAGAGAGQGGYGGLSGQGAGAAAAAA

SEQ ID NO: 2101 - protein, 46 aa, Nephila pilipes
GGAGQGGYGGLGGQGSGAAAAGTGQGGYGSLGGQGAGAAGAAAAAV

SEQ ID NO: 2102 - protein, 47 aa, Nephila pilipes
GGAGQGGYSGLDRQRSGAAAAGASVAAQGGYGGLGGQGAGAAGAAAA

SEQ ID NO: 2103 - protein, 48 aa, Nephila pilipes
GGAGRGGYGGLVGQGAGAAAAGAGEAGQGGYGSLGGQGTGAGGEAAAA

SEQ ID NO: 2104 - protein, 27 aa, Nephila pilipes
GGAGQGGYSGLDRQRSGAAAAGASVAA

SEQ ID NO: 2105 - protein, 20 aa, Nephila pilipes
QGGYGGLGGQGAGAAGAATA

SEQ ID NO: 2106 - protein, 21 aa, Nephila pilipes
GGAGRGGYGGLVGQGAGAAAA

SEQ ID NO: 2107 - protein, 27 aa, Nephila pilipes
GAGEAGQGGYGSLGGQGTGAGGEAAAA

SEQ ID NO: 2108 - protein, 23 aa, Nephila senegalensis
GGAGQGGYGGLGGQGAGAAAAAA

SEQ ID NO: 2109 - protein, 18 aa, Nephila senegalensis
GGAGQGGQGLGGRGAAAA

SEQ ID NO: 2110 - protein, 27 aa, Nephila senegalensis
GGAGQGGYGGLGGQGAGRGAGAAAAAA

SEQ ID NO: 2111 - protein, 25 aa, Nephila senegalensis
GGAGQGGYGGLGGQGAGAAAAAAAA

SEQ ID NO: 2112 - protein, 22 aa, Nephilengys cruentata
GGAGQGGYGGQGAGQGAAAAAA

SEQ ID NO: 2113 - protein, 24 aa, Nephilengys cruentata
SGAGQGGYEGPGAGQGAGAAAAAA

SEQ ID NO: 2114 - protein, 27 aa, Nephilengys cruentata
GGAGQGGYGGLGGQGAGQGAGAAAAAA

SEQ ID NO: 2115 - protein, 32 aa, Nephilengys cruentata
GGAGQGGYGGLGSGQGGYGRQGAGAAAAAAAA

SEQ ID NO: 2116 - protein, 24 aa, Nephilengys cruentata
SGAGQGGYGGPGAGQGAGAAAAAA

SEQ ID NO: 2117 - protein, 29 aa, Nephilengys cruentata
GGAGQGGYGGLGSGQGGYGGQGAGAAAAA

SEQ ID NO: 2118 - protein, 22 aa, Nephilengys cruentata
GGSGRGGYGSQGAGQGAAAAAA

SEQ ID NO: 2119 - protein, 22 aa, Nephilengys cruentata
GGAGQGGYGGAGSGAAAASAAA

SEQ ID NO: 2120 - protein, 37 aa, Parawixia bistriata
GGYGPGGAGQQGPGAGQQGPGSQGQSGPGATVAAAAA

SEQ ID NO: 2121 - protein, 37 aa, Parawixia bistriata
GGYGPGGAGQQGPGAGQQGQGSQGPYGPAATAAAAAA

SEQ ID NO: 2122 - protein, 36 aa, Parawixia bistriata
GGYGPGSGQQGPGAGQQGPGGQGPYGPSAAAAAAAA

SEQ ID NO: 2123 - protein, 36 aa, Parawixia bistriata
GGYGPGSGQQGPGAGPQGPGSQGPYGPGAAAAAAAV

SEQ ID NO: 2124 - protein, 36 aa, Parawixia bistriata
GGYGPGSGQQGPGAGQQGPGGQGPYGPSSAAAAAAA

SEQ ID NO: 2125 - protein, 37 aa, Parawixia bistriata
GGYGPGGAGQQVPGAGQQGPGNQGPSGPGAAAAAAAA

SEQ ID NO: 2126 - protein, 37 aa, Parawixia bistriata
GGYGPGGAGQQGPAAGQQGPGSQGSYGPGAAAAAAAA

SEQ ID NO: 2127 - protein, 36 aa, Parawixia bistriata
GGYGPGSGQQGPGGAGQQGPGGQGPYGPGSSSAAAV

SEQ ID NO: 2128 - protein, 30 aa, Parawixia bistriata
GGYGPSSGLQGPAGQGPYGPGAAASAAAAA

SEQ ID NO: 2129 - protein, 39 aa, Parawixia bistriata
GGLGGQGGLGGLGSQGAGLGGYGQGGAGQGGAAAAAAAA

SEQ ID NO: 2130 - protein, 39 aa, Parawixia bistriata
GGLGGQGGRGGLGSQGAGQGGYGQGGAGQGGAAAAAAAA

SEQ ID NO: 2131 - protein, 37 aa, Parawixia bistriata
GGLGGQGGLGALGSQGAGQGGAGQGGYGQGGAAAAAA

SEQ ID NO: 2132 - protein, 39 aa, Parawixia bistriata
GGLGGQGGLGGLGSQGAGQGGYGQGGAGQGGAAAAAAAA

SEQ ID NO: 2133 - protein, 39 aa, Parawixia bistriata
GGLGGQGGLGGLGSQGAGPGGYGQGGAGQGGAAAAAAAA

SEQ ID NO: 2134 - protein, 38 aa, Parawixia bistriata
GGLGGQGGLGALGSQGAGQGGYGQGGAGQGGAAAAAAA

SEQ ID NO: 2135 - protein, 47 aa, Parawixia bistriata
GGLGGQGGLGALGSQGAGQGGYGQGGSQGAGQGGYGQGGAAAAAAAA

SEQ ID NO: 2136 - protein, 42 aa, Parawixia bistriata
GGLGGQGGLGGLGSQGAGQGGYGQGGSQGAGQGGAAAAAAAA

SEQ ID NO: 2137 - protein, 39 aa, Parawixia bistriata
GGLGGQGGFGGLGSQGAGQGGYGQGGAGQGGAAAAAAAA

SEQ ID NO: 2138 - protein, 41 aa, Parawixia bistriata
GVLGGQGGLGGLGSQGAGQGGYGQGGAGQGGAAAAAAAAAA

SEQ ID NO: 2139 - protein, 39 aa, Parawixia bistriata
GGLGGQGGRGGLGSQGAGQGGYGQGGAGASSAAAASAAA

SEQ ID NO: 2140 - protein, 32 aa, Peucetia viridans
GAGAGQGGRGGYGQGGFGGQGSGAGAGASAAA

SEQ ID NO: 2141 - protein, 34 aa, Peucetia viridans
GAGAGQGGRGGYGQGGFGGQGSGAGAGASAAAAA

SEQ ID NO: 2142 - protein, 34 aa, Peucetia viridans
GAGQGGRGGYGQGGLGGSGSGAGAGAGAAAAAAA

SEQ ID NO: 2143 - protein, 41 aa, Peucetia viridans
GAGGYGQGGLGGYGQGAGAGQGGLGGYGSGAGAGASAAAAA

SEQ ID NO: 2144 - protein, 41 aa, Peucetia viridans
GAGGAGQGGLGGYGQGAGAGQGGLGGYGSGAGAGAAAAAAA

SEQ ID NO: 2145 - protein, 27 aa, Peucetia viridans
GAGGSGQGGLGGYGSGGGAGGASAAAA

SEQ ID NO: 2146 - protein, 166 aa, Poecilotheria regalis; identical to SEQ ID NO: 1389

SEQ ID NO: 2147 - protein, 166 aa, Poecilotheria regalis; identical to SEQ ID NO: 1390

SEQ ID NO: 2148 - protein, 166 aa, Poecilotheria regalis; identical to SEQ ID NO: 1391

SEQ ID NO: 2149 - protein, 42 aa, Tetragnatha kauaiensis
GGLGGGQGAGQGGQQGAGQGGYGSGLGGAGQGASAAAAAAAA

SEQ ID NO: 2150 - protein, 42 aa, Tetragnatha kauaiensis; identical to SEQ ID NO: 2149

SEQ ID NO: 2151 - protein, 45 aa, Tetragnatha kauaiensis
GGLGGGQGAGQGGQQGAGQGGYGSGLGGAGQGAGQGASAAAAAAA

SEQ ID NO: 2152 - protein, 36 aa, Uloborus diversus
GGSGGQGGQGGYGSGGQGQGQGGYGAGAAAAAAAAA

SEQ ID NO: 2153 - protein, 36 aa, Uloborus diversus
GGSGGQGGAGAGGQGGQGQGQGGYGSGAAAAAAAAA

SEQ ID NO: 2154 - protein, 33 aa, Uloborus diversus
GGLGGQGGYGSGRQGQGQGGYGSGAAAAAAAAA

SEQ ID NO: 2155 - protein, 36 aa, Uloborus diversus
GGSGGQGAQGGYGSGGQGQGQGGYGSGAAAAAAAAA

SEQ ID NO: 2156 - protein, 35 aa, Uloborus diversus
GGSGGQGGQGGYGSGGQGQGQGGYGSGAASAAAAA

SEQ ID NO: 2157 - DNA, 1380 bp, Artificial Sequence
  Description of Artificial Sequence: Synthetic polynucleotide
ggtttgcagccctccgccggatatcagcctggagcaggttatcagccgggaactggcttgcaaccgggagctggataccaacctggagctggacttcaaccgggtgcaggagtacaaccaggagctggagttcagccaggagccggacttccaccatcagctggattgcagcctggcgcaggtctacagccgggagccggcttacagcctggaacgggataccaaccaggtgctggttatcaacctggagccggcttgcagcctggagccggacttcagcctggagctggactccaacctggcgctggattacaacctggtgcaggataccaccctggagcaggtttgcaacctggtatcggaccacaaccaggagccggcttgcagtccggagcaggactacaaccaggtagcggtttgcaaccaggagctggttatcaaccaggacccggtctgcagccaggtgcaggatatcagccttctgctggtatccgtccagacatgggactccaaccaggtgctggatacaagccaggttcaggctatcaacctggaagttcgtaccaacctggtgctggattgcatccaggtattcagcagggaactggactacatccaggtacaggtttgcaacctagagtaggcttacagccaggcgctggtgtgcaacccggtgctgaataccagcctggttccggttatcaacctgatgctagtttgcatcctggtgctggtctacaacctggaggaagattgcaaccatctgccggtctacagcctggtactggattgcaaccaggagtcggagtacaaccaggtgcagaatatcagccaggatccggatatcaaccaggagctggcttgcagccaggagcaggtttattgcctggtggtagattacagccgggtgcaggacttcaacctggtacaggtttacagccaggtgctggatatcaaccaggttctatctaccaacctggtgcaggatatcaacctggtgccggactccaaccgggagctggtgtgcaaccaggaaccggttatagaccaggagcaggattacagcctggtggacgcttgcaaccatctgctggattgcagccaggtgccggacttcagccaggtgcgggtgttcagccaggcgctgaataccagccgggatctggataccaacctggtgcgggactacagccaggaactggaatccagcccggtgcaggtctgcaacctggtgtaggccttcaacctggtgccggtttacaaccaggagctgtcctccaacctggaacaggatatcagccaggagcaggctatcagccaggtactggattgcaggctggagctggattgcaacctggagctggtttgcaaccaggatca

SEQ ID NO: 2158 - DNA, 1086 bp, Artificial Sequence
  Description of Artificial Sequence: Synthetic polynucleotide
ggttcacctttagaggagaagtacgacgagaagtccgaagctgatgactaccaatcagaagattcatctgctgccattcacgaccagacaaccaaaatcgccactaatgccgtgaaaacttacgctaataaggccaaggctaccgagtcaaaggctaagttgtatcatcaatactctaaggatcgtgcctattatagcagagaatacgagaagatgggagaagaatatatgaagaagtccaaggagtatgaacagctttatatagccgaggctgctaggatcagcttgcacgagaataaacaaaaagagtgggacacgaaaggtagagaggcaaatgttggaataagagagtacgaaactaagtcccaacaggcttcttcgaagaaaaatgagctattggaagagagcattatcgctgctgttcaggctgcaatccatgaaacgcaggcaacaggatatctgctaaaatcagaggctgcaaacggtattgctaggaacatgttgcaaattgcagagtctattagggacgaggcctctaatcactaccaaattggtaaagaagagttgaatagagcaaccgctcagaaggtaaaagctcaacaacaggccgaggattctcagcgccaccatgctgctgcgagagcttatcaacaggactctctaagatctagaatggcctccagagccaataatatgcagtatatgcagaattcattattggcagaaagagcacactcgctttctacggagaacactttggaatcagaattgtatggaaaggaggctgacgaattggctaaaatgtcggaagagtccgccgctatctcgaaaatttgttcaggagaggaaagatcctacagaaacatggctaagcagtcagaagtgaaagcttacgaatattccgtatcgaagaatatgatgggtgcagatatgaccgataccgctgcaatggctaatggcgacgaagctaagcaaggtgacgacgaggagcagcaaatgtataggtcacctaacatccctgccgaggatagtaccaagaacctttcctataacttaaaggattctactgagggtgaaggtatgtca

SEQ ID NO: 2159 - DNA, 1053 bp, Artificial Sequence
  Description of Artificial Sequence: Synthetic polynucleotide
ggtaaaaaacatgaagccttaaccttcggttctggctacaagtcaacttacggcgaaggtgaaacattcgacgacgaggatgaccaagctttacgtaatgagagagtgccagtaggagctttatctgcagctatcataaacccttacgctctacacagtgaagaaggaagaatagcttacgatacgtcgagccaatactacgcaaataaggccgagggttcggcagacctttcccgcgaaaaaaagcagatgcatggtgaatatcatggtaaagctgccacatacgcgtccagggcgaacgaggcttataagaagtcccagttgcataagcgtcaagccaaagacaaacaggctattgccaaggagtatgaggagcgggctcagaaacatgaatcgaggtcaaaggctctcgatgtacgtgaccaagatgacgagcgtaaatcagtcactgaaatggaggaatacgctagagctctaaagatcgctaatcttgcccttgtctttgctggtatttaccaggagactggtcgattacaattggaggccaccaatgtttttgagcagtttcataaaatgctgtccacaaaaggcgaagagtataaaaaacaagcagaggaatacaaggaaaaggccaataaggagaaggaggaagctgccatccagcaagcaaaaagtaaagaattgaatgctaaagcacaagaatatgaaaatatttttatagagtcctctaagaagctggctgctaatcgttattacgagcttgaattcaaaatgaaagccgagaacgaaaggcatcacgctgaattggcacgtattagatctaggtttttgagtaggctagcaaactataatagagagcaagcagaagctgtcctcagatttgctcgatcagaaagaaaagacggagaaatttttaggcgcaatgcaatcgaactctataaagagactagagccctagctgctacagccgcaagagttatgaagcaacaccgttatacgggtcaagaaatatacacgaaacaaccttttcctcattctaactatcacggagca

SEQ ID NO: 2160 - DNA, 1092 bp, Artificial Sequence
  Description of Artificial Sequence: Synthetic polynucleotide
ggttcacctctggaggaaaaatatggtgagaaatatggagatatggaggagtatcagagaggtacggaagattcaagagccgttattaacgaccatactgccaaggtggcctcccaatctgcacgaggaatggttaacaaggctaaaaccacagaagccgctgctagatctaacgagcaactttctaaagatcgtcagtactactaccgtgagtatttgaagaaagccgattaccataagaaaaaggctttggagtacgaacaattgtcagcagccgaaaacgccaaaatcgcctaccacgagagtaagcagaaagattgggagacaaaagccagagagtctgatgtccagtgtagagatgctgaagccaagtatgaacaaagttatactagatctcgtgaattgaagagagagtctattatagcgtatgttcaagcagctatgcatcatgccgaggcgtctggtgaccatatgaaagcggacagagctaaggacattgccagagatatgatgaggaaagccgagtccttaaggggtgatgctagtaaccattaccagagaagcgaggaggataagaacaaggcaaggtctgagaaggtcaaagctcaccaaaacgcagataattcccaacgccaccacactgcttgtagggcctatgaccaggagggattgaaaactcgtctttcctctaaggctaacatgatgagacaaatccattcatctttactcgcggaacgaagccactctttggctagagaggacggtctagccgctgatttgtcacacaaactagccgaagagcttgctagaatgtctgaggagtctggtgcgatttcaaaaattaattcgggagaagaaagaggttattccaataaggtgaggcaagatgaagttaaagcacacgaactcgctgttagcaagagaatgatgggtgcagaggtggccgataattctgagatgatttccctggcacaagcaaaagatggttccttggatgagggtgagaattataagctctctactttctatgcagacgatagcaccaaaaacatgttgcccgattcaaggggacaaatgagctatggtgatgaa

SEQ ID NO: 2161 - DNA, 1044 bp, Artificial Sequence
  Description of Artificial Sequence: Synthetic polynucleotide
ggtaagaaccatgaagtcatgacctatggctccggatataaaactatgggtgatgagggaggatcgggtgttggcaacgaaggtgaggactatcaagacaacgaaggagccactgcagctactattttggacgagtctacccatcataccgaagaggctcgcgacattttcggtacacgttcagaagcccatgcctacagtgcggagatgtttgctgacttagttagagaaaagagacaagctagtatcgaaagccacaagaaggcggaggactacgccgtcagagctaatgaagagtccaagaagagtcaacttttaaagagacaggcgagagataagcaagccatagctaagcagtatgaagagaaggctcagaagtacgacagaatcagtaagcaacaagacattaaagaacaggatgattacagaaagtccgacgccgagagtgaggagtataagcgttccattgctgtcgctaacgctgctctggctctagcgtccgcttacgaagaggcatctcgtatggagcttgacgccactggtgagatggaacaacaatccaaggagctttataccaaaagtgaagaatataataaggttgcggaagaatgcattacccgtgccaaaaaagaaaaagaactagcgagaatagaagaagcaaagggtaaagaagcagaggctaaaagtcaagaatacgaaaacttcgcgactgacaacaacaagaaatataacgcaatgaagttttatggttgggagttcaagatgaaagctgagaacgaaaggcacaacgctgattactgtagaattaaaagtagatacttggcccagttatccaattataacagagagcaggccgaggcgctttaccacttcgctgctgcccagagaaaggatgccgaattgtttcatcgatacgctatggagttgtataaacagaccagagtgcttactgctagcgctgcccaaattatgaagcaacatcgttacactggccaagaaatctactctaagcagcctttccctcattcgaactaccacggagca

SEQ ID NO: 2162 - DNA, 1098 bp, Artificial Sequence
  Description of Artificial Sequence: Synthetic polynucleotide
ggttcgcctctagaggacaaatatgatcagaaatatgaagttgaagattacagaggtggtagcgaagataccaaagctgctatcaacgataatgcagccagagtcgcttcacattccgctaagtcacacgtcaataaggccttagtggtagaagctgctgctagactaaatgctcagattgccaaggaccgtaactactatgctagagagtacacaaagttggccgaagagtctaagaagagagccagacaatatggtcagctggccgacatggaggcaggtaggattggacaacacgaacatatgcagcaagaatggaattcgaaggcaagagagtccgaagctcaatgcaaagcgaccgaagccaaagctcaggaggaatacaccaaagccagagatgagcgtcagaaatcgttggtttctaacgctgaggctgccatgcatgatgctcaagccactgttgacactatgaagtccgaaagggcttatgagattggaaaagagttaatgcgcaaagctgagaacgctagaaacgatgcttccaaccactatcagcgagctaaggagaatagagaaagagctaatagtgaaaccgttaaatcacaccaacaagctcaagacgcccagagacacaacgccgcttccaaggcctaccagcaagatggcctccgaacaagaatggcctctagaattaacattatgaagtacattcagtccagcttgttggctgaaagggctgccaaccaagctagaatagagcaactcaagtctgaatggtacgagaaggcagctaacgagtactccaggatgtctgaagaaaatgccgctatttccaaacttgcaggttctgaggaacactacttcgctcaaagagcgaaaagaaacgagggcaaggcttatgaattgtctcagtcaaagagaatgatgggttccgaggctgccgctgccggagaactgctggctatgtcacaggccaaggatgacgagactgaagatgagaagcatttcgactttccaatttacgagtctgacgatccaactaaactgtcgccatctccggacgaaaaagatttgacatacggttctggtgagggccta

SEQ ID NO: 2163 - DNA, 1026 bp, Artificial Sequence
  Description of Artificial Sequence: Synthetic polynucleotide
ggtaagaagcacgaagtcatgacttacggttcaggatataaacacatgggtggagaaacttatgaggacgttggaactggaaacagactaggctctactgctttcgacatcatggaagccgctgacgaaaacaccgagcgagcgtcccatactttcggttcaaaatctgccgcatactcgtccgacgctgacttatttattgagctcctccgggaaaagcgtgagacgagagcaaaccatggtaaacgtgctgaatcacaggcagttttagctaacgagtcgtaccagaagtcccaattgcataaaagacaggccaaagataaacaagccatttctaaagagtatgaggagagagctcaaaaacacgatagactttctaaggagcaggacatgaaggaacatgatgactatagaaagtctaatgcagaggacactgaattgaggaatagtgttgaacgttcaaactatgaccatgtgatggctttaggttatcacgaacttagtcaactcgaaatgggtgaaactaatcaatgtgaacaattgtccagagagctacaatccagagctgaagagtatttcaacctggccaaagaattgaaagagaaagccaagaaggaaaaggaaaatgcccgaattaaaaaggcaaaagccaaggaagaagaagccagagcagaagaatacgaaaatgcctttactgaaaatagcaagaaggtattagcatacaagttttatgagctggagttcggtatgaaggctctaaatgaacatcatcaggctgaatcagcacgtgtccgccatcactttttacagattttagagcaacacaatagtcaacatgcagacatgctttggggatacgcacaacaggaagataaagacggtagatcttttactcagtacgcgaccgagctctcaaagcagaccaaaatgctcaccgctaccgctgctcacctgatgaaacaacaccgctatacgggtatggagatgtattcgaagcaaccgttccctcactctaactaccatgga

SEQ ID NO: 2164 - DNA, 750 bp, Artificial Sequence
  Description of Artificial Sequence: Synthetic polynucleotide
ggtcctagaggttggtatggccctagaggattgggcccccgcggtctgggaccattaggattggattcagacatcattggagatggttacggtccgtatggtttgggatctcgtggattgggaccattgggacttgattctgacataatcggtgacggctacggaccaagaggattaggtccacacggattgggccctagaggtctaggtccactaggtttggattcagatataataggtgatggatacggaccttacggattgggtcctaggggtctgggtccattgggaggtttgggaaggcgaccttacggtggatactctgcatctggttctgtatctgccgaaggcccacgtggatggtatggcccacgaggcttgggtggaattggtggttggagatccagaccatatggaggttactcggctagccactctgtcagtgttgaggccccagttgtataccatgcacctatcataaggagagctcccaaaatttctagatcatcctcctactccgtggaaagaatagttacaccaactgttatcaccagaatctctggttctcattccgtatccgcagagggtagaagaggtgtttggggtccacatggagtctggggacctagtggcctttacggcgattcaggtatagtcgacggagtctacggacctggtttggttggccctggaggctggggaagaaggccatatggaggatactccgcttctagatctgtcagtgctgaa

SEQ ID NO: 2165 - DNA, 840 bp, Artificial Sequence
  Description of Artificial Sequence: Synthetic polynucleotide
ggtccaagaggctggtatggaccacgcggtctaggaccaagaggattgggacctttgggattagattctgacataattggtgatggatatggaccttacggactcggctcacgtggcctcggccccttaggtctggacagtgacataatcggtgatggatacggtccaagaggtctgggaccgagaggactaggaccacttggccttgactccgacataataggagacggttatggaccctacggcttgggtccacgcggattgggtccactcggaggtttgggaaggaggccctatggaggttacagcgcatctggtagtgtttctgcggagggaccacgcggatggtacggcccgagaggcttgggtggtattggcggatggcgttcgaggccatacggtggatactcagcctcccattcggtgtctgttgaggctcctgttgtctaccacgcaccaataattcgtagggctccaaaaatttctagatcagcttcttatagtgtcgaaagaattgttagacctaccgtaattactaagatccataagtctgtttcgcattctgtggaacaacctatttactatcgaccaccagttgttgttcgcgctccaaaagtcagcaagtctgaatcctattccgttgaacgtattgtaactccgacagtgattactcgaatacatcactccgcatctgattctgtagaacagcctatttattacagacctcctgttgttgttcgacgtccaaagatttctagatctgcttcttattcagtagaaagaatcgttaccccaacagtgattactaggattagcggctctcactcagtctccgctgaa

SEQ ID NO: 2166 - DNA, 384 bp, Artificial Sequence
  Description of Artificial Sequence: Synthetic polynucleotide
ggtaagattggccataacgcccagaaaggtatcgatgacttcttgggtggcgcccacatctcgaaatgtggcaaacatgagcgaattttacaaggagaggatattattgaaactaacgctaaaggagaactgatcgagaagattgtgtcacgtaaggagattcttacagacgatgatagcgaatccttctctgtttcctacagtagtgaggacgattctacagaaactatagttaagactattacaatcgtgcaagagattcctaagcatggaaaaggtaagggtcatgctaaggaaaaaattttcgaagaagaaacggttatcaaaaaaatcggaaagggtgtcgccgcacctgtagttgctcctgctgttgacatagttgga

SEQ ID NO: 2167 - DNA, 600 bp, Artificial Sequence
  Description of Artificial Sequence: Synthetic polynucleotide
ggtagacgcggtgtctatggtccacgtggcgtctggggaccatcgggtttatacggcgattctggaatcctcgatggcgtatatggtcctggtttagtaggaccaggaggatggggacgtagaccatacggtggttactccgcttcttcatctgtgtcggcggaaggcccaaggggatggtacggtcctagaggactgggtcctagacgtatcggcctgggaggctactcagcctctggttctgtaagcgctgagggaccaagaggatggtatggaccaaggggcctaggacctcgtagaataggttctttaggtggatactcagcgagtggttctgtttctgctgaaggtatcagaggcgtacttcgtccgtcccctggtattgtggtgcctggtgttatatcctccggtgtggttgctcctggcttagttggcggacatggaggattagtgaacgtcggtggaacccacgtcttgccaggtacatctgtctatactacacatccagatcctagaacggttagatcttcctgtagaacctccccctacaacctattgattaaagttggtaacgctagaaagctgaatggcaattgttca

SEQ ID NO: 2168 - DNA, 771 bp, Artificial Sequence
  Description of Artificial Sequence: Synthetic polynucleotide
ggtaacagatactacgacctatggaacacatgctgtcaaagaccaagatacgacggatgcggtatttttggaaaccatctatgggattacgttaagtactcagcctcatggtcacattccgtagaaaactatgatgttggttaccatggattttactgggatgattcgtgggtgcatggcgtgcctcatggtaactactactacccgctttggaattactgctgtcaacatccaagatgtaataggtgcggaatttttggccatcacttgcaggactatgttaagtactccgcatcatggtccacctctgttgagaactacggttacgatgtcagttatccgggtttctactgggataactcttgggtgcatggtgtgccacatggaaatcactattaccctctatggaactactgttgccaacatccaagatgcaatagatgcggaatcttcggacaccatctacaggattatattaaatactctgcttcttggagtacttcggttgagaattatggttacgatgtcggctacccaggattttactgggacgactcctgggttcatggtgtcccacatggaaatcattactatcctctctggaactattgctgtcatcatcctaggtgcaaccggtgtggtatttttggccatcatttgcaagactatgtgaagtattcggcttcttggtctacgtccgtcgaggactacggtggatacgattacgacttctactgggacgactcttgggtacatggcgttccacatcta

SEQ ID NO: 2169 - DNA, 816 bp, Artificial Sequence
  Description of Artificial Sequence: Synthetic polynucleotide
ggtcgaggtctgggcagaggtaaacacggctggggaggacttggacacggaggactaggaggtttgggtcatggaggactgggtggtctaggtcacggtggcttgggaggactgggtcatggcggtttgggtggcttgggttccgactctggcgacttaggcggaataggcggtctgctgggaccaggtggtcgtagaggttggggtcgtcgaggcccgggtaagtattctgcttcggtgagtatttctcattctatttctatcgaacgagtaattacacctggcgtttacacttctatacatagatcggtttctgtttcgcactcagtctcggtagaacatagaaggagaatagctccaattgtcgtggactattccatttcgtctagtcttagtatctcaggcgaaggaagaggacttggaagaggtaagcacggctggggtggcctcggccacggtggactaggtggcttgggtcatggtggcctaggaggtctgggacacggaggtttgggaggtttaggacacggtggacttggtggccttggaagcgattctggtgatttaggaggtattggtggccttctgggcccaggaggaagaagaggttggggcaggagaggtccaggaaagtacagcgcttccgtttccatttcccactctattagtattgaacgagtaatcacgcccggagtttacacttcaatacatagatctgtgtcggtttcacattctgtctctgttgagcatcgtaggagaatcgctcctattgtagttgactactctatctcctcctcattgtccatttccggagaa

SEQ ID NO: 2170 - DNA, 816 bp, Artificial Sequence
  Description of Artificial Sequence: Synthetic polynucleotide
ggtaggggacttggtagaggcaagcacggttggggtggcctgggacatggtggtttgggtggtcttggacatggaggtttaggaggcttgggtcatggcggactcggaggtctgggtcatggtggactcggtggtctgggttccgactcaggagatctgggcggaatcggtggtcttttgggacctggtggtcgccgcggttggggcagacgtggtccaggaaaatattccgctagtgtttctatatcacactcaatctcgatcgaaagagtgattactcccggcgtttatacttcaatacatagatctgtttcggtttctcattcggtgtcggtcgaacatagaagaagaatcgcccctatcgtcgttgattactcaatatccagtagcttgtcgatctccggtgagggcagaggtcttggtagaggaaaacatggttggggtggcttgggtcacggtggacttggcggtttgggccatggaggtttgggaggactaggccacggtggtcttggtggcctcggacatggtggacttggtggtttaggaagcgacagtggtgaccttggaggaatcggaggtctattgggtcctggtggaagaagaggttggggacgtagaggtccaggtaagtactcagcatcagttagtatttcgcattccataagtattgagagagtcataacacctggtgtctacacttctatacacagatccgtctctgtgagccactcagtaagcgttgaacacagacgtagaatcgcaccaattgttgtagattacagcatctcttcaagcttatctatttctggagaa

SEQ ID NO: 2171 - DNA, 654 bp, Artificial Sequence
  Description of Artificial Sequence: Synthetic polynucleotide
ggtagaggtctaggcagaggaaaacatggttggggtggcttgggtcacggcggtttaggtggactaggacacggtggtttgggtggtttaggtcacggaggactcggtggtctgggacatggtggattgggtggtctaggtagtgattccggtgatctgggtggaatcggtggattgttgggtcctggaggaagaaggggatggggtagaagaggccccggaaaatatagtgcaagcgtctccattagccattccatttcgattgaaagggtcattaccccaggcgtttacacttcaatacataggagcgtgagcgtctctcacagtgttagtattgaacgacctcgccgtatcattagtcctgtcgtagattattcattatcaatctcagcatcctcctctgtttctgctgaaggtggccgtcgtagaagattacctggatcctgcggtactattatttccgattcttcgagtaacgttggtggccttggaagaattggtgctctacacaagttgggtggaggccgaatcccaagacctgctatctataccagacaccctggactcaaaggattaaagccacaatgtcctctaagtaactttaatgttcatgtcaaagtaggaaacattagaaaagccaatggtaactgcgga

SEQ ID NO: 2172 - DNA, 768 bp, Artificial Sequence
  Description of Artificial Sequence: Synthetic polynucleotide
ggttccagtgtaatcgacaagttggaagatttactgactcacggacaccatggtcaccattgggaaggcacagatggtttgcacgaaaaattgctgcaggaggatgacgtcattgaagccaactccaagggagagatcattgaaaaaattatctctagacgcgagattattacagacgataattctgaatctgaatcagattcagattcttctgaggactctggcagcacagagaagatcatcaagcaaattatcatcgtccaagagaagccgaagcatggacaccaccacgctaaggaaaagatatacgaagaagaaattattattaagaaaattggtgatttgcctaaaaaggattgtgatgaaaataagcctagagaagtaacttcgtggcgtcacactttacctaatagaaaaagtatttcaatctcaaaatccatctctattgaacaaataatcaaaccacatgtcatcacgagaatccgcacttctaagtctagttccttgtccatttcggtggagcgtcctagaagaataatttccccaattatctcgggtggttggaacagacacaaacctagaaagtacagcgcatcttcttccattagtaagtcgatctcaattgaaagggttatcactccagctgtgtggaccaggattcacaaatcagtgtccgtttctcattctgtttcagtagaacatagaaggcgaattgccccgatcgttgtggattactctatcagttctagtttatctatttctggtgaa

SEQ ID NO: 2173 - DNA, 1272 bp, Artificial Sequence
  Description of Artificial Sequence: Synthetic polynucleotide
ggtagaagaagaggaccgtggggatacggcagaggattgtctggatccggtgacctagacggcctaggtggtgtgggaggactcggtggtttgggcggcttgggaggcagacggggtccttggggtaggggctatggcagttcgggaaccgttagtgtctctgtttccgtcgaagagggtagacgtcgtggaccatggggaagaagaggcaaagtatcaattagccgttctgtttccatcgagagaattgtaacgccaggtgtgtacacacaaatctccaggtcctcatcagtttctgtggaaggaggaaggagacgtggtccatggggacgaggttatggacctactggttccgtgagcgtttcagtttctgtagaaggtggtcgaaggcgaggtccttggggttatggaagaagattaggaggattgagcggtagcggagatttggatggcctaggtggtgttggaggtttaggaggactaggaggtttaggtggtaggcggggtccttgggttagaggttatggcagctcggtgtcagtcagtgttagtgtggagggtggtagacgacgaggaccgtggggtagacgaggtaaagtctctattagccgttcaggatctatcgaacgtattgtgaccccgggagtatacactaagatatctagatcatctagtgtgtccgttgaaggtggccgaaggcgtggtccctggggacgaggctacggtagctccggctccgtttccgttagcgttgaaggtggacgtagacgaggcccttggggaaggaggggtaaggtgtctatttctagaagcgtatccattgaaagaatagtcacccctggtatttacactaaaattagtagaagctcaagtgttagtgtcgaaggaggcaggcgcagaggaccttggggttacggtagaggactaggtggactctccggctcgggcgacctggacggattgggtggtgtcggtggactaggtggattaggaggtttgggaggacggagaggaccttggggacgtggatacggatcttcgggttctgttagcgtttccttatcggtcgaaggtgtgaggagacgcggaccttggggtagaagaggaaaagtctccatctccagatctgtctcaatagagagaatcgttaccccaggaagctacagcaagatttcccgttcctccagcgtttccgttgaaggaggaattcgtagaggcccatggggcagattcggtggttttgtttcctccggttcttcatcagtcgagtca

SEQ ID NO: 2174 - DNA, 2202 bp, Artificial Sequence
  Description of Artificial Sequence: Synthetic polynucleotide
ggtcctattgcaaactttgttggattcgtcatctctttgcttttctctttattcgaggtgatggtgtcagtcgttttcgacgtaaagtcctttacctctttgagcactccaacttgtaattctacggtgccatccttcgccactagagtcggtggtggtagattcagcggtatcataactgcttccttcaacatgatagctatgatcagtgctaacgtgcaagcaatacaatcaggctctggaagtaccagtggatcatcgtcctcctctactacatctacctccaacagtacaactactacttccaactccaccaccaccacgactaattcaactactactactagcaattccacatcctcttcaaattccacctcaagtggtcttacaagcagtgctagcgttgtctctctgatagatacaatcgcctgggtgtaccaggactcttcggttggaattgcttacttgatggtttctattttagctcttttctatggacaaagcgtttcagctccaccataccctgaccttggcattccagccttgccggctaattgctccggccctggagtcccacagtctgttcaaatcagagccgctattgcatatgtgaacatcacaatttacttcattaacatgacaggacaacaatttgaggatctacaaggtcccgttgccactgattgtggctgcccaaacacgacaagcgttgctccattagtccttgagtgggaagctatcttggctgccttgcaagccctggcaaacagtaccgcttctgctaacagcacgacttcatcaaactcaactaccactactacaaccaactctacatcaaccaccactacaaattctaccacaacaactaactcaacctcctcgtctaattcgtctaccatagctggatgtattgatatatctgcgaacttaactatcgctttgcagaacttgcaggctcttctattgcaagagagcacttgtgctccagcactcgctgcaaatgccaagaagtcgggagtgagggatatgtccccttgtaagcctggaaaaacagcaagtggatgtgccaaatctggcgaaaaaaaagttaaaagaaaggctaggctcgaaaagatgcgagcaaagtgccgtagagcggttggtaacagaatgaaaggatcaatgaagaaacgtgtgagatcacgcgccaagaagttcggtaaggccgcaaagtcgggtgtaaggcgctaccgaaaaaatattaaatacgtgtatatcccacctgttatggcctcccttaatgcttacgctgctctgatggcttcgttgtctgaatcaatttcttctcaatccgattccgctcttaactcgactgatcaagcctgtaactcaactggatctaacacggatgcagctgttattgctgctacgaacaacgtcacagacatgttcgcaaattttactgcaatggttttgaataatactgttgcttacccaaactgcacacagtttgctgatatggctttgctaatgatctctcagattaacgatcagatcatttcttgtggctcgcagtctgatgatgctgagtctagcatatactttaatgtaacaatgaatatcgtcgctatggctcaagagtataacaacttcgcttccatgtctgacaagtgtacaagatctttcgcgaattcttggctctggatgtatattaagtgggtgttttatcggatgggaatgacatcgggaattccaaattttctggcctgccaaactaaggctgagagttctctaactgcctttctggcatcatttaatgctactatcaatgccacaatagcagctgcttcggctaactcatcctcggttcagagttccgaagcttcttgcattgagagtagtctatctgacgcctcagctatcttggcaatgtatgagaacgcttaccagaactgcgtcgcacctggttccgttcctgatgctgccaatacaactacaacatctacgactactacgaccacaacaacaactactgctgccccaacgactactaccactaaagctgcaaacgctccattcacctacccactatgtaacctccagatgacggctgcttgcgtggcggctctaccaacatgtacctacccattcatttcatcagctggatgttgtccatctggtaagaccctaaacaccggtctgggtggaaggggatgttgtaaa

SEQ ID NO: 2175 - DNA, 894 bp, Artificial Sequence
  Description of Artificial Sequence: Synthetic polynucleotide
ggttgcgagtgtggatgcgctgagctgaattgtccgcagaataagaaaccaaacaaagaaacatgcgagtgcgaatgtaagattctggctaagtgtaacgacggacaagtgtttaacaaggacacgtgttcttgtaattgtcctggaagcgcttcggacaaagtctgcaagaagcctcaaatctacaataacgagtcttgtaaatgtggctgtccggtagatatgcagaaaccaattgacggttgccctaggcctcaaagatgggagtctgattcatgtagttgcgaatgccctcttaaacaagattgcaaaaatggtaaagtgtgggacgcaaccatctgccaatgtatctgtcctcgtgatgcattgccatgcgctgctggtaaggaacgatgtggagaatcttgccaatgtaaatgcatcaatagagagccaaaagaaggatgttcaaagtcacttgtctggaatgaggacaaatgtgaatgtgtatgcccagcaggtaagcagatgcctgttggtggttgcgagtctggtaaatcctttaacgcattgacatgtcaatgtgagtgtgacgagtccgcttcaaagtgcggaaacaaacgttggaacgcggatacatgtaagtgtgaatgtcaacctggaaaaccgccagaaggttgtggcaagcaaacctggatctctgaaaagtgtaaatgcgaatgttctcctgctattacctgcgaggccccacaaatcttggatccaaacacctgtgagtgcaaatgtcctgtcaatatgcttgccgaaaaggagaaatgtaaactaccaagacaatggacagactccaaatgcttgtgtcaatgtcctaccgccccagtgacttgtgaaggtaaagaaacctggtgtggtgaaaca

SEQ ID NO: 2176 - DNA, 891 bp, Artificial Sequence
  Description of Artificial Sequence: Synthetic polynucleotide
ggttgccaatgtgagtgtaaaaacaaacaagagatggctaactgcaaatctccaagaacatggaactatgacacttgcaaatgtgattgcaagaacgcggatgattcagatgattgtgttaagccacaaatttggttggataaccaatgtaaatgtggctgcccagcatcagcccagatgacttgcgccgacaacaaacgattcatagaaaagtcttgtaagtgcgaatgcaagttagctatgcctgccactattccgccaggaaaaaaatggaacgaggataaatgtgtcctcgaatgtgcaaacgttaagacttgtgagggtcctcagagatggtgcgataatcagtgcaagtgcatctgcccgcaagttaacactaagtgttcggacaagcagaagtttatcgagtctaaatgcgagtgtggctgtgacacgcaaacgcaatgtaagaacggattcagatggtctaacttagagtgcggttgcctgtgtgatgagaaaaaatgccagggtaagcaagtgttcgacaagaatacttgtcagtgtaaatgcccaaatcaaaagccaggtgacacatgcggaaacggaaaagatttttgtccacttgattgttcttgtaaatgtaagtctcctaaaccagctaatggctgccctggtgttcaagaatggaacgaagaaaaatgtcagtgtgagtgtcctaaggacaaaccaaaaaagcaatgtcctggaggtcaagattggaataaccacttgtgtcaatgtggatgtccaactcctgcgcccacttgtagcaataagcagaagtacagtaatgtttcttgttcttgcggttgtaagcccggtaaacctaaggaaggcagacctggtaagcaaatctggtgcgaaaacaca

SEQ ID NO: 2177 - DNA, 897 bp, Artificial Sequence
  Description of Artificial Sequence: Synthetic polynucleotide
ggttgccagtgcgaatgccctaaaccaatgcctacggagggttgcggaccacaaagctggaacggagagtcctgtaaatgtgaatgcccttcatctattacttgttcctctcctcaaattattgacaaagatacttgtgagtgtaagtgccctaaaaatatgctagctgataaggaaaaatgcacggccccacgacaatggatcgattcaagctgttcttgcaaatgccctaccactccagctgtgtgtgagggtaaccaaaaatggtgtgacgaatcctgccaatgcacttgccctggtggtaagaaagagtgcggtgacaacaagtactttgatgagtcaagttgtgaatgtaagtgtaagtctaatcctacctgttcggacccacaaatttgggatgctgacgactgttcgtgtaagtgtccgaaggataaaaaaatgccgaagggcggttgtcttaatggacaagagtggaacaaactagcctgttcctgtggttgccctgaaccacgtcctgtttgtactgacgagcagacatataacaataatacgtgtaaatgcggttgtggcattgacaagccttcatgcccgaagcaacaaacttacaattggaataagtgccagtgtggttgtccagaggaaatgaagaagccagccggaggttgcggtgctaagacatggttggaagaagattgtcagtgcaattgcgttcctggtaaacctgctggaggttgcttgggtgctcaaaagtggtgcgacgacgaatgtatttgtaagtgcagtaacagtgaaccagccaagggatgtggaaataaacagtggtctgatgtcagttgtgattgtgagtgcccaactaaaaagacctgtgcggatcctcaggtttgggacgctaacaca

SEQ ID NO: 2178 - DNA, 858 bp, Artificial Sequence
  Description of Artificial Sequence: Synthetic polynucleotide
ggtccatacggcgacggtttgggtccaagaggatatagtgcgtccgctagccagtccggcgaaggcggttggggatacggaccttacggcggtagtcttggaccatatggaggttccttgggacctagaggatactccgcttctgcctctagaagcgttgagggaggatggggttatggcccttacggaggcggtgtaggtccatatggtggaagtttaggaccatacggagatggcctcggaccatatggctctggagtcggtccgtacggtgatggattgggaccatacggaggtggtgttggtccatacggagacggacttggtccttatggcggatctttaggtccttacggtgatggattaggtccttatggtggaggagtcggaccttacggtgacggtcttggaccatacggcggttctttgggaccatatggtgatggactcggtccaagaggttactccgcctccgcatcccagtccggtgaaggtggctggggttatggcccatatggcggctcactcggaccatatggtggttcccttggaccacgcggatactcggcatctgcttcacgtagtgtcgagggtggatggggttacggtccgtacggtggaggtgttggcccatacggaggaagcctaggaccttacggagacggactgggtccatatggatccggtgtaggaccttatggtgatggtcttggtccttacggtggtggtgttggtccttatggagatggattgggtccatacggaggatctttgggaccatacggtgatggtctgggcccatacggtggcggtgtcggtccttatggagacggattgggtccttatggtggctcctta

SEQ ID NO: 2179 - DNA, 960 bp, Artificial Sequence
  Description of Artificial Sequence: Synthetic polynucleotide
ggttccgcaggagcctctagtaacggatccgttgctggtgcatcaaaaggtgccgcaggagcttcaagtaacggttcatccgcttcagctagtaagggaagtgctggagcaagttcaggatcgtctacggccactgccagtaaaggatccgctggagcctcttcaaatggttcatctgcttcagctactaaaggatcggctggagcttcttccggaaacagtacagccgtagcctccaaaggcagtgcaggcgcaagtagtaatggcagttctgcttctgcatctaaaggttctgcaggagcctcttctcagggatcgtctgctagtgcgacaaaaggatcagctggcgcgacctcaaatggatctagtgccgtcgctagtaaaggttcggccggtgcttccagtggaaacagcactgcttctgccactaaaggtagttcttctgctagtagtaacggaagctctgctggtgcatctaaggacggagctggcgccgctagcaacggttccacggccgtggcgtctaagggttccgctggagctgcctccggcaacagtactgcatccgctacaaaaggttcctcctccgctagctctaacggatcctctgctaccgcctccaagggttccgccggagctacttctaatggatcctctgccgttgcttcaaaaggaagcgccggagctagttccggaaattcgacagcttcagcatcaaaaggttctgccggagcttcttcaaacggatcttcagccacagcaactaagggatcagctggagcaacctcaaacggaagctcagctgtggcatcgaagggatccgccggtgcttcctcaggtaattcaacagcaagtgcttcaaaaggcagtgcgggtgcttcgagtaatggatcatcggctaccgcgacaaaaggttctgctggtgccacatccaatggttcgtcagctgtggcatcaaaa

SEQ ID NO: 2180 - DNA, 477 bp, Artificial Sequence
  Description of Artificial Sequence: Synthetic polynucleotide
ggtcatccaacagattgcggcaactcaggaggctctagtggctcatctgctgcatccggagccgcttcctcttctggatcgggttctgcagctggatcaggtgcggcctcaggttccggagcagcctccggatctggagcagctagtggtagtggtgccgcttcaggtagtggtgctgcatcgggtagtggcgccgcaagtggctctggcgctgcatcaggaagtggcgccgcatctggcagtggcgctgcatctggttcgggagctgcctctggttcaggagctgccagtggatctggtgctgcttcgggctcaggagcagcgagtggttcgggagcagcttcaggctcgggatcagcttccggctccggtagcgcttccggttcaggatcctcttctggttcaggttcctctggttgtggatcaggaggctcagcatcaggatcctccggtggttcctcagcttcggcttctaaa

SEQ ID NO: 2181 - DNA, 558 bp, Artificial Sequence
  Description of Artificial Sequence: Synthetic polynucleotide
ggtagtgcgggtgcctcatctggtaactccacagcttcagccagcaaaggatcagccggtgcctcttcaaacggttcctcagcaactgcttctaagggatctgcaggagctacctccaacggctcatcagcagtagcttccaagggtagtgctggtgcgagttccggcaatagtactgcttctgcctcaaaaggatccgctggtgcatcgtctgatggttcatctgcttcagcatcaaagggcagcgcaggagctacttctaacggctcctcagctgtcgcttcaaaaggctctgccggtgccagctccggtaattccacagcctcagcttcaaagggaagtgctggtgcttcctcaggaggaagtaccgcggcagcctctaagggatccgcatctgcaagtagcgacggtttttcagcagcttgtgactccggtgaatctgaggcagtggacaaagcgaacctagcagccattgccaatattgccgctgcagcaggtaagccagccgcatgtggttccgcaccaccttctgacgactattacgattacggttgtgga

SEQ ID NO: 2182 - DNA, 768 bp, Artificial Sequence
  Description of Artificial Sequence: Synthetic polynucleotide
ggtagctcggctagtgcctcgaaaaactccgctggtgccagctcaaacggctcatcagccggagcaagttctggttcagccggtgcttcgagtggtggatcttctgcatccgctacgaagggctcagctggagcatcgagtggcggaagttccgctggcgcatcaagtggttcagctggcgcttcttccggcggctcttctgcctccgctaccaagggatccgctggtgcttcctctggttcaagttccgctggtgcatccaatggtagtgctggtgcatcctccggaggttctacagcaagtgctacaaaaggctctgcaggagcatcctcaggaggatcgacagccggtgcatcgaacggaagtgcaggagccagtagtggtggatccagcgcatcagctactaaggaaagtgcaggcgcctcttcaaacggatccagtgccggcgcctcgaacggcagtgctggtgccagttctggtggttcatcagcttctgcaactaaaaactcagctggagctagctctggtaattcctctgcgggcgcatcaaatggttctgcttctagcagctctggatcctcctcctctaccgccacaaaggaaagcgccggtgcctcgtctaatggcagcactgcttctgcaagtaaagatagtgctggagcttcatctggaggttctagtgctggagccacctgtagcggagctggagctgcttctggaggttccgtctcaagtgcaactaagaattcttccgctgcatcttcacaa

SEQ ID NO: 2183 - DNA, 864 bp, Artificial Sequence
  Description of Artificial Sequence: Synthetic polynucleotide
ggttcctcaggtggtgccacttcttccgctggcgctggatcagcttctggctcctcgggaggaagtacttcgggagcctccgccggatcggccagcggatcttccggtggatctagttcttcggcgggtagtggttctgcctccggtagctctggcgactcgtctagttccgccggatctggaactgcttcaggaagtagcggcggtgccacttctagtgctggcgcaggatctgcctcgggatcctccggtggttctacatctggagcaagtgccggatcagcatcgggctcttcaggtggaagttccagttcagcaggttcaggaagtgcatctggatccagtggcgattcatcgtcatcagctggttccggaactgcaagcggatcttcgggtggtgcaacatcttctgctggagctggatccgccagtggaagttctggaggttcgacttccggtgcttctgcaggaagtgcttccggaagtagtggaggatctagtagttctgcaggttctggaagcgcatccggttcatctggagactcttcgtctagtgctggaagcggaagcgcgagcggcagctcaggaggttctacttcaggagcatctgccggttcagcatcaggttcttcgggtggctcgtcaagttccgctggttctggtagtgccagcggttcatccggtgattcaagttcatcagctggctctggatctgcttccggatcttcatgtggatcaacctccggcgcttccaatggctccgcttcaggaagttcgggtggaagctcttcatctgctggatcaggttcggctagtggatcctccggagattcctccagctctgcaggatctggcagtgcttca

SEQ ID NO: 2184 - DNA, 399 bp, Artificial Sequence
  Description of Artificial Sequence: Synthetic polynucleotide
ggtcaagatagtggatgtaatgtcattgcctaccctactgcttcatgtggtgatagtggatcaggctccgccgcttcttctggtgcggcgagtagttccggctccggatccgccagtggaagtggagcagctagtggtagcggaagtgccagtggtagtggagcggcatcaggttccggatcagctgcaggaagtggagccgcttctggatccggagctgctagcggatctggatcggcctccggttctggttccgcatctggcagcggctctgccgctggttctggcgccgcttcaggatccggtagtgctagtggttcaggtagtagttcttcaggatcttctagttctggatcctcaggaggatgtggaggtggctctggttctgcaagttccgga

SEQ ID NO: 2185 - DNA, 486 bp, Artificial Sequence
  Description of Artificial Sequence: Synthetic polynucleotide
ggttcgtcgggcggatcctccagtgcagccggtagtggatccgcttccggagcatctggaggagctacctctgctgcaggaagcggttctgcttcaggatcttctggaggatcttcttcaggagctagttcaggttcagcctctggctcctctggaggttgtggttctggaggaagttccggaagtggtagtggaagtgcttcaggaagcggtagtgcttctggcagtggatctgcatcaggttctggatctgcctctggaagtggagccgctagtggtagcggagctgcttccggatctggcgctgcttccggtagtggagcagcctccggttctggagccgcttctggatcaggagctgcaagtggatcgggtgccgcttcaggttccgccgccgcttctggtgccgcttcttcctctggatccgctagtggctcaggttcaggttctggttctagtgacgattctgaggacgactcttgtgga

SEQ ID NO: 2186 - DNA, 630 bp, Artificial Sequence
  Description of Artificial Sequence: Synthetic polynucleotide
ggtgctaatggagcagctgctgcttcagctgctgctgctgcggctagaagagcaggagctattggtttgaacggagcagcgggcgctaatgtagctgttgctggcggtaagaagggcggagccgctggtcttaatgcaggcgctggtgcctcattggtatccgccgcggcaagaagaaacggtgctctcggactcaacggagctgctggtgcaaacttggcagctgctggaggtaaaaaaggtggtgctattggacttaacgctggtgcttcagccaatgtcggtgcagctgctgctaagaaaaatggtgcaataggtttgaattccgccgcatctgccaacgctgccgctgcggctgccaaaaaaggtggagcaattggacttaatgcaggagcctcagcgaacgcagctgcagctgcagctaagaaatctggtgctgtaggtctaaacgcaggagcgagcgctaacgccgctgcagctgccgcaaagaaatcgggtgcagtggctgcaaactctgctgcttcagcaaatgctgcagcggcagcacagaaaaaagccgccgctgatgctgctaatgctgccgctagtgaatcagctgccgcagccgccgctaagaaggccgctgctgta

SEQ ID NO: 2187 - DNA, 600 bp, Artificial Sequence
  Description of Artificial Sequence: Synthetic polynucleotide
ggttccgcttccggttcagctagtggttcaaagtccgaaagtggatctgcatctggatctgccagtggaagtaaatcagagtctggttctgcctctggtagcgagtccggctccgctcaaggtggaggttctaaaagcgaaagtggcagttcctcgggttcggcttctggctctaagagcgaatctggttcggcatcaggttccgcctctggatctaagtcagagtccggatccgcttccggctcaggatcaggatctaaatccgaatcaggctctgcttccggatcagcgtctggttcaaagtcggaaagtggatctgcttcaggtagtgcttctggatccaagtccgaatcgggatctgctagcggaagcgaatctggttcagcacaaggaggtggttccaagtcagaaagtggaagtagttcaggttcggcttccggatcaaagtctgagtctggtagtgcatccggttcagccagcggaagtaaatccgagtccggctctgcctcaggttccggttctggttccaaaagcgaatccggttccgcaagtggatccgaaagcggttcagcagccggaggtggctccaaatccgaatca

SEQ ID NO: 2188 - DNA, 798 bp, Artificial Sequence
  Description of Artificial Sequence: Synthetic polynucleotide
ggtgctgtttacctaagactgtcctctgacggttcatgcccagctgaccaggtttgttgtcgcgaagaggactctaatgaaatctgcggcggtacatgtgtgcctgagggagcctgtgaagccggtggtatcaacctgagggttggaggtgccggaggtggatgtagctttggagagatatgctgtgatttgccgcttaaccgatgcagaggaacttgcactactgtagatctgtgcggtgataataggagagtggacttaagattcgaggatcagctgtgtcctggttcgcaagtctgttgtgagaagtccaagacaaacgctatctgtcacggaagatgcgtcgctgctaatgaatgttcgagatcctctaacttagtggacctgcgtgtacaatcgaacgatggatgcccaggtgacagaatttgttgccagaatacgtgtgagggacaatgtgttccaagaggacagtgtggtgatgatacaaaagacattgaccttagagttggcgattcttcctgtcccgaaaatcaggtgtgttgtaagaatccaagaacctgcacttgcgtcgatccatctaaatgtccccaaatgataaaccttcgctttagttcagaatgtccatttcaccaagtttgctgcgacagcgtcagcgactctaattgtcaaggtctatgtaccccagatgaccaatgtaaggttcgctcaaatggaacctgcagtggtggtcttacatgttgtggtaaaataaagccatcttgtgatggttcttgtgtgtcccttggacaatgcccgaca

SEQ ID NO: 2189 - DNA, 774 bp, Artificial Sequence
  Description of Artificial Sequence: Synthetic polynucleotide
ggttgccctgcaaaccagcaagacccgtttgctgtgtgttgtaggaatgcgagtaaactttgtaacggttcttgtgttagtcaagagcagtgcgccgacagtggcttcgatttgagaatatcttctcaaacttgtccaggcaacgctgtctgctgtaagaacctgagcaagtcaccaacaggtaaagtctgccagggaagatgtgtacccagccagcaatgtactggacaatctcaaaactcggtcgacttgaggttttctgaaggtctatgtcctttaaacctagtctgttgtccagcaagtacgtcttgttcgggttcatgtgttgccggtaatagatgcctggacaacgctttgtccattaatcttagacgttcgactgaatcttgccccgcaggattggtatgctgccagaatgttaacaaaggttctacttgtgatggacagtgtaccagtcgtgacagatgcgctgacctcaccttgggaatcaacttgagactatctgatcagtcttgcccatccaatcagatatgttgtaagaaagtcaggaagcctttgcctgatgccgagtgtacctgcgtaatgctagaccaatgcgctgatgaccagagatcaatagacctaaggaccggtggtcaaaagtgtccatcaagaaaaatctgctgcacaaagctaaagaccacagtagaaaaatgtgatggctcctgtatctcataccaagactgtccagaaatagcaaatgcatcttctgttgatttgagattgttttccgga

SEQ ID NO: 2190 - DNA, 1131 bp, Artificial Sequence
  Description of Artificial Sequence: Synthetic polynucleotide
ggtgttcctaaagaactgggtacctcaattagctcagcttctgctagtgctagtgcttcagcttccgccaccgcttcgtcctcttcaaagaacgtccatttattgcctttaaaaagtgaacatggaattgtaatcgacaagtctaaatttaacattaggaaagtggtcttgtccgcaattgatgaaattaacggagctcctaatattggtctaggtttgaagcaagtaagcttggctcttgcaaaggctcaagcaagtgctcagtcctccgccgaggccctggccatcattaagaaaattgtcgctctacttattagtgcctatgttcgtgcagcagaagccgccgcaagagcttctgccgaggctctggctactgtgagagccgcagagcaggcacagaagattgctgaggccaagggccgtgcggctgctgaagctctgtctgagcttgtcgaagctagtcaaaaggcagatgctgccgcagctggtaccaccgacgctatcgagcgcacttatcaagacgctagggcagctacttccgcgcagactaaggcctccggcgaggccgaaaacgccaataggaatgctgctgctactttggccgcagtgttgagcatagcaaaggctgcttcaggacagggtggtacgcgtgctgctgttgatgccgctgctgctgcagcagccgccgcggccttgcatgcgaaggccaacgctgtgagccaagcgacatcgaaagcagccgctgaagctcgtgtcgctgcggaagaggccgctagtgctcaagcttcagcatcagcatctgcccaattgactgctcaactagaagagaaggtatctgcagatcaacaagctgcttcagcctccacagacacgtccgcagcaatagcagaggctgaggctgctgcattagcatccactgtgaatgccattaacgacggagtggttattggtttaggtaacaccgcttcttcgtctgcacaggcttcggctcaggcatctgctttagctagggccaaaaatgctagacctaagattaaaggttggtataaaatcggcggtgctacctccgcaagtgctagtgcctcagcttccgcatccgctcaaagctcatcacagggattggtttattca

SEQ ID NO: 2191 - DNA, 1119 bp, Artificial Sequence
  Description of Artificial Sequence: Synthetic polynucleotide
ggttcgaaaagctacttgttaggttcgagtgcctccgcatcggcctctgcatcagcatccgcatctgctggaggttcaactggaggtgtaggtgttggtagtgtaattagtggcggaaacaatattatccgtggtgcttccacaacatcggttactttagccgcagccgctgccgaagcaaaggccgctcttaatgccggtaaggccactgtcgaagaacaaagggaagccttgcaattactgaccgccagtgcagaaaaaaacgccgaagctcgttccttggcggacgacgctgccgttctcgtccagggtgctgcggaagcacagagtgttgctgctgctaaaactgtcgctgtggaacaaggatctaattctttagatgctgctgcagcggaggctgaggccgctgccgccgctagtagagtttccgctcaacaggccttgcaggccgctcaaacgtctgctgctgccatccagactgctgctggctccgctctcacagctcttaaactcgcaagaaaacaagaagctgagtctaacaacgcagccgaacaggcaaataaagcacttgcattatcgcgcgcagctagtgctgctactcaacgagcagtggctgctcaaaatgccgctgcagcttctgctgcttctgctggcgcagctcaggcggaggcaagaaacgcttatgccaaggcaaaggctgctattgctgccctaactgctgcccaaaggaattacgccgctgctaaggcctcagcatctgccggaagcgttgtggctgagcaagacgctcaatctagagctgccgacgctgaggttaatgcggttgctcaggctgctgctcgcgccagtgtcagaaaccaagagatagtagagattggtgctgaatttggaaatgcgtccggaggagttatctctactggaactaggtcatctggtggtaaaggcgtttctgtgactgctggtgctcaggcttccgcttctgcgtctgctacgagctcatccagtagttcgtccggaatcaacaagggacatcctagatggggacataactggggtctgggtagctctgaggcatctgctaatgctgaagctgaatctagtgcatcttcatactcatca

SEQ ID NO: 2192 - DNA, 1275 bp, Artificial Sequence
  Description of Artificial Sequence: Synthetic polynucleotide
ggttctgaattggttggatctgatgcttccgccaccgcgtcagctgaggcatcagcctcgtcctctgcttacggatcaaaatatggtattggtagcggtgcagtgtctggtgcttctgcatccgcatcggcatctgctagcgcctccgcaagtgctagtagtgctccagccatcgaaggagtaaatgttggcactggagtttctaacactgcatctgcctctgctgaggctctttctagaggtctgggaattggccaagcggccgctgaagctcaagctgccgctgcaggtcaagctgctattgctgcaaagtcgtgtgctttggccgcaaaatcaactgcacaggctgtcgctctggttgaaaaagttgccagagctgaagttgaccttgccgagtctgccaggaaggcgaccagattgtcagctgaggcggctaaagctgctgctgaggttgaaaaagacttagttggactcagaggcgccgctggaaaactgaatttggccgctagggcaggcagcaaagcacaggagagagccaatgaagatagtattgaggctaacgagcttgcccaggccactgctgcagctggtgctgaagccgaggctaaggccaatgcagcacaggaggctggtgcaagtgctcttgctattgcacaagcagctttgaatatagaacaagagactgttaaactcacgagacaagcacaaaatacaagactacgatctgagaatatcctggcagccgccagtaatgcgcgtgctattgcttccgcagaggctgaggccagtagtgacctcaacaatagagccaacgcagctagatcaaacgccagggctgctgctgagactcgtgctgttgccacagaggccgcttctaccgccgaaatagccgcttactcttcctcggaaaagggtgaaattaccaacccaggccctctgcctaaaattgtatcggtgactgctggtcttacacagaacgaaattgctggttcaggtgctgctgcatccgctagtgcttccgctctggcttctgctagtgctggagctggtgcgggtgctggcgctggtgctggtgcttcggcaggagccggcgctgtagcaggagccggtgccggtgctggtgccggagcttctgctggagcctccgctggtgctaacgctggagcgggagctagttctttgctattgcctcaatcaaagcttcatccaattagtcgatcctctgcttccgcttctgcatctgccgaagctgaggccaactcttctgcatatgca

SEQ ID NO: 2193 - DNA, 1143 bp, Artificial Sequence
  Description of Artificial Sequence: Synthetic polynucleotide
ggtgttattggtccagacacatcctcttcttcgcaggcatctgcttccgcttcggcttcggctagtgcctccgcatcttcttcagcgagtattggttacaacgagctgcacaaatcgatcaatgctccagcactggctgtgggtgttaagaatggaggtgtagatgtggctaagggagctgccgttgtcgagtcagctatttctgatgttagtactttgactgacgacagaaccttgaacggtttggcaatcataggcaattctgctgaatccctggcaagagcacaagcaagttcttctgcctctgctggcgccaaggctaacgcactgataaaacaatcgatcgctgctatagagatcacggagaaggctgaatatttagcatcgatagttgcgaccaaagcagctaaagcagcggaagcaacggcagccgctaccgctagggctactgccgttgctgaagccgctaaagtttcttccgagcaatttgcagctgaggctagagcagctgccgatgccgaggctaaagccaacgctgcttcaatcattgccaacaaggcaaatgccgttttagctgaagcagcaaccggtttgtctgcgtctgctggaaaagcacaacaatcagctactagagcattacaggcagctagagctgccgccaaggcacaagctgagcttacacaaaaggctgcacagatacttgttcttatcgcagaggcaaaggctgctgtatctcgtgcctcggccgatcaatctgtgtgtacatcacaggcgcaggccgcatcccaaattcaaagtagagcttctgctgctgaatcagcagcttccgcccagagcgaggccaatactatcgccgcagaggcagttgctagagctgatgcagaagctgcctcccaagcacaagcttgggccgagtcattcaaaagagaactgagttccgttgtcttggaggctgaagctaatgctagtgcttctgcttcggcgggcgccctcgcctctggttctagttcaagcggtgcttcgtcaagtgcagatgcaagtgcaggagcttcctcctatggttctctaggaggttatcgccacggtggatcgttttccgaggcctctgctgcagcgtcagccgctagcagagcggaagcggca

SEQ ID NO: 2194 - DNA, 1131 bp, Artificial Sequence
  Description of Artificial Sequence: Synthetic polynucleotide
ggtaaccttcttaaagagtctaaggcatccgcatctgcatctgccagcgcatcggctagagcttcaggtaaaaagaatttgcatgttcttccactaccgaaaaagagcgagcacggtattgtcattgataagagtgtgtttgacataaaagatgttgttctatccgctgttgacgaaattaatggtgccccaaagcttggtttgggatggaagaaagtctctatgggtgtggagagagccgaggctaatgctgctgccgccgctgaagctctggctatgataaaaaagatcgcaatggccagatcctctgcctatgttcaggcagcatgggcatccgctcaggcttccgctgacgcacttgcttctgcccgcgtcgctcaggcgtcgcaggaagccgctgaggcaaagggtcgcgccgcctccgaggctttgtccagagctatagaagcctcatctagagctgatgcagcagccgctgcgacattagatgctatggatagaacgatggaaaacgctagagctgccaacgctgcccaaactcaagcctctggtcaggccgaaaacgcgaatagatccgctgctgctattttagcagcattgctaagaattgccgaggcttctgccctgaataacgaggccgcagttaatgctgccgcagcagctgcagccgccagtgcattgcaagcaaaagcgaacgccgcatctcaagctaccgctcgtgctgcgggacaagcctctacagctgccgaagaggctcaatctgctcaggaggcagcagataaaaacgctgaactgactaccgttatgctggaaaaagcttcggctgatcaacaagccgcatccgcaagagcagactactatacagcttcgactgaggctgaagccgctgcacaagcctccgctatcaatgccttgagagatggaatcgtcgtcggtatgggcaacgacgctggagctagtgctcaggctatggcccaggtggaggccttagcaagagcaagcgaacacaaagcccttggcgagaagaaaaaaggtctggtatggggctacggttcgaaaggttcatcatctgcttccgcttctgcttcagcttctgccgaagcttcctctagattgggcaaggactgggga

SEQ ID NO: 2195 - DNA, 1212 bp, Artificial Sequence
  Description of Artificial Sequence: Synthetic polynucleotide
ggttctggtcctcgccttcttggaggcaggagcgcagcttctgcatctgcttcagcgtctgcagaagcttccgcaggaggttggagaaaatccggtgcgagtgcttcagcttctgctaaagccggttcgtccaatattctaagtagagtgggcgcttccagagctgctgcaacattagttgcctcagccgcagttgaagctaaggctggattaagagctggaaaagctacggctgaagaacaacgtgaggcattggaaatgctgacgctatccgcagataagaatgctgaagcccgtattttggcagatgatacggcagtcttggtccagggttccgcagaagcacagtccgtggccgctgccaagaccgtagccgtcgaagaagagtcagcctccttagatgctgcagctgtcgaggcagaggttgctgccgcaacttctaaatcctctgccggtcaggctttacagtctgcccaaactgccgcttctgctcttcgtacttctgctaggtccgccctgactgctttaaagctagctcgtttgcaaggagccgcttcttccaacgcagcaagaatgatggagaaagcattggccgctacacaggacgcaaacgcagctgcccagcaagctatggcagctgaatccgctgctgcagaggccgccgccattgccgctgctaagcagtcagaggctcgtgatgctggagctgaagctaaagctgccatggctgctcttatcactgctcaaagaaacctggtccaggccaacgcacgtgctgagatggcttctgaggaggccgaacttgactcaaagagcagagctagcgacgcgaaggttaatgctgtagctcgtgcggccagcaaaagctctatcagaagggatgagcttatcgagatcggtgccgaattcggaaaagcatctggtgaggtcatctccactggaacaagatcaaatggtggccaagacgctattgctacggcagaggctagttcctcagcttccgccgtaggtattaaaaagacttctggtcattggggtagcggtaaatggagtcgtgtttctaaaggaaagggatgggcttcctcgaatgctgatgctgatgcgtcatcctccagcattattatcggcggactaaaaaggggtggcctgggatctgaggctagtgctgccgcttcagctgaagctgaagcctccgctggaacgttgctttta

SEQ ID NO: 2196 - DNA, 1272 bp, Artificial Sequence
  Description of Artificial Sequence: Synthetic polynucleotide
ggtagtgaacttgagtcggaagcttccgctgctgcttctgcccaggccgaggcctcatcctcgggaagatcaggtaaactgtcggcttcacaggcctctgccagtgcttccgcatccgctagcgctggatctagaggtggatctaaaggtggatggggtcaattacgacgtggagacgtgaaatctgaagctaagtccgctgccgctattgcagtcgagggagccaagatcggaactggaattggaaatactgctagtgcctccgctgaagctctgtctcgtggtctaggcattggacaagccgctgcagaggctcaagctgctgcagctggtcaggcagaagttgccgccaagtcttgcgaattggctgacaaaactactgccaaagccgtcgctatggttgaagccgctgccgaagctgagattgaggttgccaatcaagaggtggctgcggttaagttaagtacgtgggctgctaaggcagcaagaattgttgaggaagattctgctgcagttagagccgccgctggcaagttgttgctcgcagccagggctgcagcagctgctgaaagaagggccaacgaagaaagtgaagcagcaaacgaattagctcaagcttctagcgccgctgcggctgaggctgaagctaaggcaaacgctggaagagaggccgctgccgcagctttggctattgccgaagccgctgttgccattgaacaagaggctgttattctggcaagaaaggcccaggatgctagactaaatgccgaagctgctgccgctgctgctatgaacgcacgtgtaatagcttctgctgagagtgaggcaagtgaggatttggaaaatagagcatccgttgctagagcatctgcagcaggcgccgctgaggctaaggcaattgccaccgatgctggcgcaacggcagagatcgctgcctattcatgggccaaaaaaggagagttaatcaacccaggtccattgcctaaaataatttccgtcaacgctgacctttcaaagtcagaagtcgaggctatgaaaataacccgtggacaagtacaagaagtcaaaaagatttcaacgcataagggtggatggggatggggtaaggagggtagatccaaggtttcatcaaacgcttcagctagagcttccgcttctgccaacgcggctgcaggttcattgggatcaaagtggggtcgtcagttgagtgcttcctctgcctctgctgacgctaatgctgaagctgactctcaactgctcaaagtttgggga

SEQ ID NO: 2197 - DNA, 1179 bp, Artificial Sequence
  Description of Artificial Sequence: Synthetic polynucleotide
ggtcgggtgattgagtcctcgtcctctgcctcggcccaagctagtgccagtgccggttctagaggccttttgggtaaaagaccaatcggtaagttggaatggggaaaggaggagaaaaagctcgaagagttggatgaggaatctttaaatgaggccgccttgaaggtaggtatcaagaacggcggccttgatgttgccaaaggcgctgccgtactggaagctgctatgtctgatgtagctacactaaccgatcagagatctcttgtcgatctgggacttggcccagtagctaacgaggccgaaatacttgctgaggcccaagctgcaacatccgcacaggctggtgctgttgcaaactctgctgctgaacgtgcaatcgctgctatggagatggctgataggacggaatatattgcagctcttgttacgactaaggctgcaaaagcggctgaagctacgatggcagcaacagccagagctacagcagctgcttcagcttccaaaatttccagccaagaatctgccgccagtgctgctaacgctgctaatgccgaggccaaggctaatgctgcctctattattgctaataaggctaacgctgtcctggctgaagcagctgcagtcttggctgccactgccgcaaaggctaaagagtccgccatgaaatcgctttctgctgcccaggccgctgctaaggcacaggctagaaacgcggaagcatctgctgaggctcagattaagttatctcaagctcgcgcggctgtcgctcgtgcagccgctgatcaagccgtttgctctagccaagcacaggccgcatcacagatccaatctcgcgcatcagcatcagagtcggctgcctctgcacaatccgaaactaacacggctgctgcagaggccgttgctactgctgacgccgaggctgcagctcaggccgaagcttgggttatgtcattaaaaaatgatctttggttgcaccttaatatgaagggtgaagctaaagcagagggcgaagccgtttcgatctcaaaaggacatcgtggtggaattagaagtggatcaatctcggaggcttcagcagaagcatcctcgaatgtttcaatgggaggacgacatggaagaaaagatctagtctcagaggccttggccggcgcttccgctggatcaagtgcggattcccta

SEQ ID NO: 2198 - DNA, 939 bp, Artificial Sequence
  Description of Artificial Sequence: Synthetic polynucleotide
ggttcagtcgagttgggcgccccaaagcaagaatcggtacttgttgagcaattgcttttgaagaatgtggaaacctccgccaaacgcaaagaaaatggagccccaaagttaggcgagtccacggctgctgcacttgcctctaccaaggcaactgctgcagccgaagctaaggccagcgccaaagtgaaggcttctgctttggccttggctgaagctttcttgagagcttcagctgcgttcgccgctgctagcgcaaaggctgcagctgccgttaaagaggctacccaagcccaacttttggcacaagaaaaggcgttaattgcccttaaaacacaatcggagcaacaagccgcatctgcgagagctgatgccgccgccgctgctgctgtttctgctctagagcgcgctcaagcatcttcaagagccgccaccactgctcaagatatcagctctgatctcgaaaagagagtggctacttctgcagcagctgaagctggagctacacttagagcagaacaatccgctgcacaatctaagtggtcagcagccttggcagcacagacagccgctgctgccgctgcaattgaagccaaagctacagcttcgtctgaatctacagctgccgctaccagtaaggcggctgtattgactgctgatacctcaagcgctgaggctgcggctgccgctgaagctcaatcagcttcaagaatagcaggaactgcagcaacagagggatctgctaactgggcctcagaaaacagtagaacagcccaactggaagcctctgccagtgctaaagctaccgcggctgctgcagtaggagatggagcaatcatcggtttggctagagatgcaagtgctgcagctcaagccgctgctgaagtcaaggcactagcagaagcttctgcttcgcttggtgcttctgaaaaagataagaaa

SEQ ID NO: 2199 - DNA, 924 bp, Artificial Sequence
  Description of Artificial Sequence: Synthetic polynucleotide
ggtcagagttctccattattagagattgttcaaggaagcgccagtgctaccgcttccacggctgtgactgctagatctggtctgagagctggccaagtggctgtagcttcacagaaggatgccactctgcaggcagacgcttctgccgccgcagctgctgctgccagagcctcagctgaccagtccgcctcattagctcagcaatccgcctctcttcaatctaaggctgccgcacgtgctaaaagtgcagaagagtctgctgccgctaccgccaaagctgagttgcaggcagaatctatagctgcttcagcttcttcaaatgcacgtgaagcagctgcgtccgccaaggctagcgcctctgccatgtctagtgctgctgtccaagccaaattggctgaaaagacagccaaaaaccaagccttggcgtcagaggaagccaaacttaaggcggccgctgcagcttctgctgcagctgcagctagcgccgccgccgaggccgctcttaaagctgagagaattgccgaagaagccattgctaaagctgccgctgcaaaggctgctgctagagcagctgcagcagccttgaattctgctaaagaggctgcaacctcgtctgccaggtcagcagctgaagccgaggctaaatccgaagtcgctatattgatctcagaattggacaagaagtcacgagaggtagctgcctctgcgtcggcaaaagctagagcagccgctgccgcttcctcgcgtaatgcagaaaccgcggttatcggcgcaaatatcaatgtcgcaaaagaggtgcttgcaattccaattgagcctaaaaagttgccagagcctgagttggctcttaaagaagaaaatgttgccgttgcatcttctgagagcgaagttaaggttgaaacatcttctgaagcttggtctata

SEQ ID NO: 2200 - DNA, 1014 bp, Artificial Sequence
  Description of Artificial Sequence: Synthetic polynucleotide
ggtaaacctctgattgctaatgcccaaataggtaaggtcaagaccgagacgtcctcttcatcggagatagaaactttggtttcaggaagtcaaacattagtcgccggatctgaaaccctggcttccgagtccgaagcccttgcctctaagtcagaagctcttacctctgaggccgagatcgcttctgtcacaactaaagatgaacttattctaaagggtgaagccatcacaggcaaaaagttgggtacaggtgcatctgaagttgctgccgcttccggtgaggccattgctaccaccttaggtgcaggtcaggcagcagccgaagcccaagctgcagccgcagctcaggcgaaaagtgcagcggcagcagctgctaatgcaggagaaagttccaacagcgcagccgccttggttgcggctgctgcagctgcccagggtaaggctgctgccgcagcggctgcagctactaaggcatccttggaggcagccgatgctgcagaagaagccgaaagcgctgttgccttagctagagctgcttcagctaaagccgaagctttggcctctacagcagctgctgctaatactagagcggctttacaagctgaaaaatctaacgagttggctcaggcagaagccgctgccgccgccgaggcgcaagccaaagctgcagctgcggccaaggctactcagctcgcattgaaggtcgcagaaaccgctgttaagactgaagctgatgctgccgccgcagctgtcgctgctgccaaggcacgagctgtggctgatgctgctgcttcccgtgctacagctgttaatgctatcgctgaagcagaggagagagattctgctcaagcagagaatacggctggagtagctcaggctgcccttgctgccgcagaggcacaagatagctgtattggagcagctgctactcctaggcactcttcttcttatgcttggtggaaattacgcattacctcactcatagtcattctgagccctcgaaacaggagaaca

SEQ ID NO: 2201 - DNA, 885 bp, Artificial Sequence
  Description of Artificial Sequence: Synthetic polynucleotide
ggtcatgttgtgaaaagagataaggagcttaaggctccagctcttccagagttactgggagacggatcagacactttaggtgctagtatggagaatggtattaaagttgctagagccagccaaaacgttggactacgtactgagttaaatgctgccgcaagagcagcagccgccgccgctaccaagcaagcaaaagacactgaggctgctgaagctggtgcagccgcagctattgcaatcgccattgccaaacgagaggaagctatcaaagcaagcgaattggcgtctaaacttttgactgccgcagctggttcgtcagaggctgctgtatctgccactgttagagctgctcagttgaccgctgctgcttctgccgctgccaaggctagtgctagtgcttcagaagcttccgccgaagcccaggttagagctaacgccgaagctaatattgcaaaaaaggcctcggccgctgaagccaaggccgcagcagaggctcaagtcaaagccgaattagccaaaaaggccgccgcgggtttcttagctaaagctcggttggctgcctctgcggaatccgaagcaacaaagctcgcagcagaagccgaagttgccttggccaaggcaagagttgctgtcgatcaatcccaatcagctcaagcaaccgccactgctcaggctgctaccgccgttcagttgcaaagtcaggccgctaacgcggaggccagtgctgttgctcaagcagagactttgctcgttacagcagaagcagtcagtgctgctgaggcggaggccgctacaaaggctacgtcatggggcgaggaatgtcatcaaagagaaaaagtcacatttagcgaagatagattgaatgaaagacaagataattgggga

SEQ ID NO: 2202 - DNA, 1464 bp, Artificial Sequence
  Description of Artificial Sequence: Synthetic polynucleotide
ggtgacagatcttgggcagctagtgatgcaaatgctgaagcttctgctgctgttgagtctccttctctctgggaggactcaagttcagcttctgccggagcatcaaatgcggcagaaagctcaagcctctgggaagattctagttcggagaataccggagcctctaccgccgctgagagttcttccttgtgggaggattcaagttctgccagtgccagagcgagcacagcagctggttcgtcaagtgcgtgggaagattcttctataaccaacgcgagagagtctggtgcttcgggttcactctcatcctgggaagattcatcttcagcatctgcttcttcctccaccagtgctagtgcttctagttcctccagtagttcttcctcgatttcttcttcagccagtagcagctcatctgccagtgcaagcgccagtacagaggcctctaatgagtcaagaaggggcattgctatcgaaggagctttggttggtacgggtgctgcgagtacggctgcagccagtgcggagatgttgagcgacacattgggacttggtcaaagcgctttacaggctcagacagcatcagtcacgcaagctaatattgcatctgacgcttcgaaccaggccaatcgcttggctgccgccgctgccgccgctatgtctgccgcagcctcagcacaagagaatgctgctagcctagcaagagcttcggcatccgcctctgaaagcgctgcttcagcatcttcaaaggcagaagcatctgccgaggcagcaaagtctagtgccgaaaagtgtcttttacttgctcagaactcagctcaagctcaagccagagctactgagcaaagcgagtcatctaatcgtgattctgcagcaaacgccgcagctgcagcagaggcagaacgtaaagcaacactcgcactgaaagctattgctgatgctaaggctaaggctggagttgccgtagccgcccaatctgaagcagccgcagcagcagccgctgctgccaaggctagagctgatgctgaagccggagcaaacctagctgcagctgcaagagctgtggctgccgctgaggccgctgccagtcggcgaaatgaccgtcaagccggtattgcacaagcaggagcttctgcagctgcagagacaagggcattagcttcttccgccgctgccactgctaaagccgccgcttacgcgaatgccgatatccgtgcactaagtgctgcggctttagagtcctctatctcaagttcttcctcaacttccgcttctagcgcttcctcgtctgcttcctccggagccagtagtgactcctcatccggagcaagtagtggagcctcttctgactcttcctcgaattcctcttctgattcatctagtttgcttggtgatgatgcttccacaagcgcttcatccaccgcagaggccgaatcccgaacctcttctcttattcttaatgga

SEQ ID NO: 2203 - DNA, 972 bp, Artificial Sequence
  Description of Artificial Sequence: Synthetic polynucleotide
ggtaaaagagctcgaagaagctctaacgccgaggcatctgctgccacttctacttcgtcacaagccgactcaggtaagaacaaggatgcctgcgcttctgacgccattgccggtgcagctgccagtgcttcttcccaagcatctatcctcggtaagagagcaagaagaagctctaatgcagaggccagtgctgcaacaagtacatcatctcaagctgactcaggtaaaaataaggatgcttgtgcatctgacgcaatagccggagctgctgcttcggcttcatcacaagctgattccggtaaaaacaaagacgcttgtgcctcggatgcaattgctggtgctgctgcctcggcttcatctcaagcctctagtttgggaaaaagagtcagacgttcttctaacgccgaagcatccgcagctacgtctacaagttcccaagctgactccggcaagaatacggatgcttctgcgagtgatgctattgttagtgtagccgcctccgtttcttcgcaggctgacagcggaaaaggtaagtccgcaggagaatccaatgcagaagcctctgcggccgcgtccgcgtcctctcaggctgactctggaaagggcaagagcgccagtgaatccaatgctgaagcctccgctgctgcatctacttcctctcaagcagatagaggtaaagacaaggatgctagtgcttcgaacgctgaggccagcgctattgcctctacttcgtctcaagctggaagtggtaagggcaaaagcacttctgaaagtaatgctgaaacgtccgctgctgcgtccgcttcttctcaagctaacacgggaaaagataagtcaacaagtgacagtaacgctgaagctagtgcagcagcttccgcttccagtcaggcagatagaggcaagggcaaagatgcttccgaaagtaatgcagcggcctgggctgcatctgcttcttcccaatctgataactca

SEQ ID NO: 2204 - DNA, 480 bp, Artificial Sequence
  Description of Artificial Sequence: Synthetic polynucleotide
ggtgcatcaaacgccgctgaatcttcctctctatgggaggattctagttcggaaaatactggagcttcgacagcagccgaaagttccagtctttgggaggattcctcctccgcctctgctagagcttccactgcagcaggaagtagttcagcttgggaggactcctctatcaccaatgctagagagtccggagcatctggatctctcagttcttgggaggattcgagttccgcttcagcaggcgcttcaaacgctgctgaatcgtcatcgttgtgggaggactcttcatctgaaaatacaggagctagtacagctgcagagtcctcatcactttgggaagattccagttctgcttccgcacgagccagcaccgccgctggtagttcttccgcttgggaggattcttctattactaatgcaagagaatctggagcaagtggctcgctgtcaagttgggaggatagttctagtgcatccgca

SEQ ID NO: 2205 - DNA, 837 bp, Artificial Sequence
  Description of Artificial Sequence: Synthetic polynucleotide
ggtatagcgattgagggagctttggttggtacaggtgcagcctctacagctgccgctagcgctgaaatgttatctgacacattgggtttgggtcaaagcgcccttcaagctcaaacggcatcagttactcaggccaatattgcttccgatgcatctaaccaggccaacagattggcagctgctgcagccgcagctatgagcgcggctgcctctgctcaggaaaatgccgcctccttggctagagcatccgcttctgctagtgagtctgccgccagcgcttcgtcaaaggcagaggcttctgccgaagccgctaaatcatccgcagagaaatgtttgctgctagcacaaaattcagcccaggctcaggcaagagctacagaacaaagcgaatcttcaaacagggattcagctgctaatgctgcagcagccgctgaagctgagagaaaagcaacactcgctttgaaggccattgctgatgctaaggctaaggccggagttgctgttgctgcgcaatctgaagccgctgcagcagcggcggctgccgctaaggctagagccgatgccgaagctggcgctaatctggcggctgcagctagggccgtggcggccgctgaggctgctgcctctagacgaaatgaccgtcaagctggcatagcacaagccggcgcttccgcagccgcagaaactagagcgctagcctcttctgctgctgccactgcaaaggccgctgcttatgcaaatgctgatatacgcgccttgtctgctgcggctctagagtcctctatttcatcttcttcctcgacttcggcatcctctgctagtagcagtgcatcttca

SEQ ID NO: 2206 - DNA, 1065 bp, Artificial Sequence
  Description of Artificial Sequence: Synthetic polynucleotide
ggttcatctagttcctccgccgagtcctctgcctcggccactgcatcatcggatgcaagttggtctgcctctagtagaagttcggctactggtagagcacctaatgttatcttgaaccgagccccacagctaggagctagcgctgctgctattgcgagtgcacgtgcatcaactagtgctaatgctgcatctgatgagaagtctgcccgtgaaacccgtgctactgccttggctagatccagagctgctgtaactgcagccgcaagggcagcagctaggacgcaggaggcagtagccgctgcgaaggcagccagcagagctcaagctcttgctgctgccaagtcgagcgcggctatctcggccttagctgccggtgaagccgcagcacaaaaggccgatgctgctgcgttggccgctttggctgctaatcaaagatcagtaaaagctgctgaaaacggattggctgtacagaacagagctaacggagaggctgagcaggcgtcaagagctgcagctgccaacttggctgcagctattagaactagagataatgctttggaaacaagaagggaagctgcaaggttaaaagctctagctaccgccgctgccaacgcaaataataaggctacttctctagctgaagcctctgcaaaccaggcagctgaggcctcctcagcggcggaggatacttcatctgctcaaagcgcagcagttgcccaagcggaagctgcagaaacattgaatgtgaatttggccattctagagtccacccaaagcagtcgtcaggactcaaatgttgcgaaggcggaggcctccgcagcagcaaaagcatcccctggaaccgccaccagagatggcgtaaacttgggactggcctccgacgctggcgctgctgcacaattgaaagcccaagccgctgcactggctagagctagctctagaatcagttctggtccagcactatctgcttggaaatggagaaatgaagattcctcagaatctagcacttccgctatcgcttcgtcgtccgcttctagttcgagttcatctagatctgcttcagga

SEQ ID NO: 2207 - DNA, 1377 bp, Artificial Sequence
  Description of Artificial Sequence: Synthetic polynucleotide
ggtgctgagagttcttcttccagtagtgcagcctcttctgcatcatcaagcagctccgagagtcgaggtcaacttttgcttcctttagaaagatccagcactagatcattgttagaccttgttagctctgcccgatccaacactgctataacagcttcaagcgctgctgccgccaaagctactttacgtgctatcaaggctgcaaattccgctcaaggtgaagctttagcacaagccactgccagtgctgcttcaaatgcaaaagcacgtgctactgccgcagctgcagctcaggcaacaaatgctgcggttaacgctcaaggtaaggccagcgcacaagcaatagctaccgctgaagcagctgaagctttgacgaaatccgcattacaagctcagagcgctgcttcctcatcgaaatctgaggctgctcaagcctccacgtcagccaatgcaggcgctggtgcattggccactgcttccgctcaggccttgtccgccaagaaggccgccctcgcttatgcttccgctgcagcagatgcttctaccgcagctgctaaagcaagagctgcagtggctgccgctgaagccgctacacgtaccgctgtccaagctgaaagagactccacaaacgctgcctcccttgcagctaaggcacaggccgaagccagagctgccgccgcagccgcagctgctgctagattagccgcttcagcagctgctgacgcttctgcccaagctgatgcaagggtccgtacagcttccattgaagctgccgcatcagcgcgtacgaaagcttccaatgcgcaggcgacagctgaggcggctgcaatcgctagatccagtagtagagacgctcaagctaactgggtggataataggtcctcagctagctcctcctcagccagcgcttctgcctcggtgtcagcttctgctagcggagaggcagattcagaggccgacagtgatgcttcagcctcagctagaagtgcagctgactccaatgccggctcaagttcaggtctggctgccgactctgctgcagacactgctgcaggatcaactgccggttctgcggctcgtttatctgccggatcagccgctggctccatagcgagaagcgcagctggttctactgctggctcatcaacaggcagtggtgctggagcatctgctgaaggctccagtaacgcatcttcgggcacttccgcaggagcttcatcaggtgctagtactggagcatccgctggagcttctgctaccgcgagtgccgataactcagctgataattctgctgaggcactttccagttcgtcagctgaaagctctagctcctcttggtcatcttcatctcaaaacatttggtcccaagactgggga

SEQ ID NO: 2208 - DNA, 1062 bp, Artificial Sequence
  Description of Artificial Sequence: Synthetic polynucleotide
ggtccatcaaggttgtcggaaacttcggacagctcggccgcctcctggtcatctagttctagttcttcttccagtttgtcctcttctctcgcaagcgattctgcttcctcttcagcttctggatccgcaagtgcatccgctagtgcttctgcttcagcttccgcaagcagcagaaatgataactccagagtaaaggcatggaagaagggaaggggtggttccgatagcctggtcctatcatccgacagttccgaggatagtaaggctagagagcttttagaaactgacgcaggtttgggtgctgccgccgcgcttgcaagagctactgccgatgcacaggcacgaactgctgctagtgctgatgctactgctaacaaagctactgctaaggcattggttttagcagaagcagctgttagggctgaaaacgcggctattgtccgtatccgtagggctttgtctgctgctcaagcactcgtctccgctagcaatcgagccaaagccgccgcaagggcagcaagagaagctgcagctaacagtgctgcagccgccgctaaagcctctaccaatcaagtcaaagcaaacgcagacagtttggtagccaacagagctgctgctgctttactggctgcagccgaagaagcactgcagaaggcttctgcgtcccagaacgcagccgcagaggctgctgcgaaagctagagccgctgctaatgcgaatgcagctactacacgagccgctgcttcggccatcttggccgaggcccgtgcacgtactgctataacgaaggcattagctgctcaatctacggcttccgcacaagcatccagcgcctctcaagtccaaaacagagctaacaatttgcaagctgagactgctagcttggctcaatcaagagccgaggccgctatcgcggcagcagccgctcaggctgcagctcttgctgaagcaaatgctcagttggcaagattgagtaaggcttcagcaggagcttctagtgagggttctgctagtgcatcggcctcagcatctgccagtgcttcatcctcctcctcttcagca

SEQ ID NO: 2209 - DNA, 972 bp, Artificial Sequence
  Description of Artificial Sequence: Synthetic polynucleotide
ggtgctcgtgaagaagtggagactagagacaagactaagacatctaccgttgttaaaagtgaaaaggttgaagtagttgctcccgctaaagatgaattgaaacttacttccgaacctatctttggacgtagagtcggaaccggtgcttccgaagtagcctcgtcctctggagaggctatcgctatatctcttggagctggacagtctgctgcagaatcacaagcgttagctgcctcacagtcaaagaccgcagccaacgccgcaatcggtgcttctgaacttactaacaaggtagcagccttagtcgctggtgctactggtgctcaggctcgtgccactgctgctagctcctctgccttgaaagcttccttggctactgaagaagctgccgaggaggctgaagccgctgttgccgatgccaaagccgccgctgaaaaggctgagtcactagctaaaaacctagcttcggcctcagctagagccgctctcagttcagagagagctaatgaacttgcccaagctgaatccgcagcagctgcggaggcccaagccaagactgccgctgctgcaaaggcagccgaaattgccttaaaggtggctgagattgctgtaaaggctgaggcggatgccgcagccgctgccgtggctgctgctaaagccagagccgttgcggacgccgctgctgccagagcagcagccgttaacgctattgccaaggccgaagaggaggcttctgctcaggcagagaacgctgcaggcgtcttacaagccgctgcctccgctgctgctgaatcccgtgctgccgccgctgcagctgctgccacttctgaggcagctgctgaagcaggtccacttgctggcgagatgaagcctccgcactggaaatgggagagaattccagtcaaaaaagaggagtggaaaacttcaactaaggaggaatggaaaaccactaacgaagagtgggaagttaaa

SEQ ID NO: 2210 - DNA, 873 bp, Artificial Sequence
  Description of Artificial Sequence: Synthetic polynucleotide
ggtagagtcataaatcacgaatcccttaaaacgtctgaagatattcaaggtggttattctgctggaattgtaggtgatggttcggacgccctgggtagttctattgagaatgctcaaaaggtggcacgtgccgctgaaaacgtaggcttgaatcttgaactgggtgctggtgcgcgtgccgccagcgttgccgccgcggctcaggcaaagaatacggaagctgctgaagctggtgctaacgcggcgcttgctgccgccattgcaaaacgtgaagaagctattaaggcctctgagatagcgaatcagttattgactaacgcagctaaggccgccgaggctacagtaagtgcaactaaacgcgctgctcaattaactgcagctgcaaaggaggctacccgtgcctcagctgctgccgcagaggcagctactgaggcacaagttaaagctaatgctgattcgatcatcactaaacgtgcagcaatcgcagaggctcaagccgcggcagaggcccaagtgaaagccgcgatcgctagaaagtccgccgctaactttcttgctaaagcacaaattgcagcagctgctgagtccgaggcaaccaagttggctgcagaggctgtcgttgcccttacaaatgccgaggttgctgtcaatcaggcccggaatgctcaagcaaacgcgagtactcaggctagtatggccgtgagagttgactcccaggctgcaaacgcggaggccgcagcggtagctcaagccgaaactcttttggttactgctgaggcggtagccgcagccgaagctgaagtggccaacaaagctgcaacctttgccaagcagatagtaaacgaaaagaagattcatgttgccaaattagaa

SEQ ID NO: 2211 - DNA, 951 bp, Artificial Sequence
  Description of Artificial Sequence: Synthetic polynucleotide
ggtgtagaggagtttaaaagctctgcaactgaggaagtcatttcaaagaacttggaagtggatcttctgaagaatgttgatacatccgctaagagacgcgagaacggtgctcctgttttgggaaaaaataccctccaatctttggagaagattaagacatctgcctcagtgaacgcaaaggctgccgcagttgtgaaggcctcggcgttagctcttgctgaggcttatctgcgggcatcagccctgagcgctgctgcttcagccaaggccgctgccgctctgaaaaatgctcagcaagctcaattaaatgctcaagagaagtctttggcagccctgaaagcacaaagtgaagaagaggctgcctccgctagagccaatgctgcaacagcagccacccaaagcgccttggaaagggcacaagcttcttcccgtttggcaactgtagctcaaaacgtggccagtgatcttcagaaaagaacctctaccaaggctgctgctgaagctgcggccactttgagacaactgcaagatgccgaaagaactaagtggagtgccaacgcagctcttgaagtttctgccgctgctgctgccgctgaaaccaagaccactgccagttcggaagcagctaacgcagcagctaaaaaagctgctgctatcgcctccgatgcagatggtgcggaaagatccgcctctacagaggctcagtccgctgctaaaattgagtctgtcgccgccgcagagggtagcgctaatagtgcttctgaggactccagagctgcccagttagaggcttccaccgctgctagagcaaatgttgctgcagcagttggtgacggagctataattggactgggtgaggaggccggagctgctgctcaacttttagcacaggctaaagcattggctgaagtctctagcaaatcagagaacattgaggataagaaattctca

SEQ ID NO: 2212 - DNA, 945 bp, Artificial Sequence
  Description of Artificial Sequence: Synthetic polynucleotide
ggtctggaaggaccaggaaacagtctcccagaattggtcaaaggatccgcctccgcaacagccagtaccgctgtaactgctagatctggtttgcgtgctggccaggtggcccttgcctcacaaaaagatgctgttttacaagcccaggctgcagcctcagctgcaagtgaagctcgcgccgcagccgatttgactgccaagcttagtcaggagagcgcttctgtccaatcgcaagctgcagctaagggaaaagaaaccgaagaagctgctgttggacaggctcgcgctggtcttgaatccgttagcatggctgcttccgcaacctcggccgctaaggaagctagtactgctgctaaggcggcagctagcgctttgtcaactgccgtcgtgcaagctaaaatagctgagcgagctgcgaaggctgaggcggttgcttcagatgaagcaaaggctaaggccatagctgccgccaacctcgctgcagaggcctcagttgcagcggaagccgctttaaaagctgagaaagttgctgaagaagctatcgccagagcagccagcgctaaggcagctgcacgagcagctgctgcagctttggcttctagtaaggaggctgccacagcttcagctagaaacgccgctgaaagtgaggctcgtaatgaagttgctgtattgattgcggagatcgacaaaaaatctcgtgaaatcgatgctgcttctagtttgaacgctagagcagccgctaaagcctcaagtagaaatgtcgagactgctactatcggagcaaatattaattcttcaaagcaagtggtttccatcccggttgagataaaaaaattttcagaacctgaggtttctacgtcttggagagaagatgaagaggtgaccaaggagaaaaaggagcacattaatttgaatgattttgatcttaaatctaatgtgttctca

SEQ ID NO: 2213 - DNA, 672 bp, Artificial Sequence
  Description of Artificial Sequence: Synthetic polynucleotide
ggtgctaacgccaattctgactccaactccaattctaattctaatgctaactccgacgcaaacagtaactcttactccaactcgggagctaatgccaactcgaactccaattcgaattcgaatagcaacgcgaattctgatgcaaactctaactcgtattcaaacagcggtgccaatgctaattcaaattctaattcaaactcaaatagcaacgcttattccgacgccaactctaattcctattctaattcgggtgcaaacgctaattcttactctaacagtaacagtaactctaatgcaaattctgacgctaactcaaatagttactcaaatagtggtgctaacggaaacagtaattccaactctaactcaaactctaatgctaatagcgacgccaatagtaacagttacagtaattccggatccaacgccgactccaacgccaatagtgactcaaatagtaacgctaacagtgatgcaaactccaattcttatagcaatagtggagcctacgcaaattcaaacgctaattcaaattcaaatagtaacgcgaactctgacgcgaactctaattcatattcaaattcgggtgctaacgctaattcgaacagtaactccaactctaattcaaatgctaattccgacgctaactctaactcctactccaattca

SEQ ID NO: 2214 - DNA, 702 bp, Artificial Sequence
  Description of Artificial Sequence: Synthetic polynucleotide
ggtgacggcagtggtagcggaagtggatcaggatcaggtagtggtagtggatctggatccggctcgggaagtggatcaggttctggtagtggaagcgattcaggatcgggatccggaagtggccatggttcctctagttcttcgtctagcggagatggatcaggtagtggttctggttccggatctggatcaggatccggttctggttccggaagtggttcaggttctggttcaggaagtggtagtggatccggtcacggatcgagttccagttcttcatcaggtgatggtagcggtagtggatccggtagtggcagcggatcaggttcaggttctggatccggctctggatccggatccggtagcgactctggttcaggctctggttcaggtcatggctcttcatcaagttcatcttcaggtgacggatctggttccggttcaggatctggatcaggttccggttcgggatctggaagtggcagcggctccggatccggatctggatccggatctggttctggacacggctcctcatctagtagctcatcaggagacggcagtggttcaggatctggcagcggcagcggatcaggaagtggttctggttcgggtagtggaagcggctcaggaagtggttcgggatccgattctggctcgggatcaggttctggtaacggctctagcagttcgagtagttca

SEQ ID NO: 2215 - DNA, 546 bp, Artificial Sequence
  Description of Artificial Sequence: Synthetic polynucleotide
ggtaataatttaaatgcccaaaatatggctgcaggttctaatactcagataactgctggtaatgttataggttcagctatccagaacacagcggctggattggctgcttcagcaaacattatcaacaacggtgtaaacagaattgttactaattcaaacactaagggattagttaatactatcagcaggattaataacttgaacggaagaaacaacggagcattgggtttgaacggaaacaacttacagggccaggttcctttggtaaatggtgtgaaccaggccgtcaccaactcgaacacgcagggattggtcaacactatttcacaaatcaacaaccttaacggtggaaacaacggtgccttaggtgttaatggtaataatctgcagggtcaggttccattggtcaacggtgttaaccaggctgttactaacagtaacacccaaggtttggtcaacaccatctctcagattaacaatcttaatggaggaaacaacggcgctctgggtgtaaatggtaacaatctacagggccaagttccttta

SEQ ID NO: 2216 - DNA, 540 bp, Artificial Sequence
  Description of Artificial Sequence: Synthetic polynucleotide
ggtaacaatcttaacgcccagaatatggctgctggatccaatacgcagattacggcaggaaacgtaataggcagtgccatccagaacaccgcagccggtttagctgcatctgctaatatcattaataacggcgtcaatcgaattgttactaatagcaatactaaaggtctggtgaatactatttcacggatcaataaccttaatggtaggaacaacggcgcccttggattgaacggtaacaacctacaaggacaggtccctcttgtcaacggagttaatcaagctgtgaccaacagtaatacacagggtttagtaaacactatttctcaaattaacaatttgaatggtggcaataacggagcattgggagtcaatggtaacaatttgcaaggccagttgccactcgttaacggtgtgaaccaggccgtgactaattcaaacacccagggagtggtaaacacaaatagtcaaatatcgaacctcaatggagctaacaacgttgcattgggtgttaatggaaataacttgcaagaagcccta

SEQ ID NO: 2217 - DNA, 546 bp, Artificial Sequence
  Description of Artificial Sequence: Synthetic polynucleotide
ggtaatagcttgaacgctcaaaacatggctgccggctctaacacacagattacagccggcaacgtaattggttccgcaatacaaaatactgctgccggactggcagcctcagctaacattatcaataacggtgtcaatagaatcgttaccaattccaatacgaagggtttggttaatacaatctctagaataaacaaccttaacggcggtaataacggtgccgttggactaaacggcaacaacctacaaggccaggttcctctggtcaatggtgtaaaccaagcagtaaccaactctaacactcaaggattagttaatactatctcccaaatcaacaacttgaacggaggaaataatggcgccctcggtgttaatggtaataatttacagggtcaagtgcctctcgtgaacggtgtgaaccaagccgttacgaattcaaacacccaaggactagttaatacaattagtcagatcaacaagttgaatggtggcaacaacggagctttgggtgtgaacgttaacaatctccaaggtcaagtccctcta

SEQ ID NO: 2218 - DNA, 1218 bp, Artificial Sequence
  Description of Artificial Sequence: Synthetic polynucleotide
ggtagaccatcgggagacgacgacgtccgaattatttcttcgaccaaggacgttacttctactggaaagagaagatcaaactctaagaacaatgtcgctcaatcttcctctcaaaaggacagtatccgggtaaaggactcaaatgaagtcattaaatccatctccgaaaatgatcctgacggtacgcgtattactacctcaaagggtacaggagtcggttctgaaacattgaatgaaaatttggttgagttgaatcaaaatacagtatcagacaccaactctgtcgaaacttcctccgataaatctaacagtgtgactacttacgacgctgatgatagaccgctgaccgtcaccgacagaaaaggccaaaaggatgtgaagtccgccactaatgctaaggaagatagttcggaagtgtcagaaaattctgaatctgaaaccaattggcaatcagagtctgactctgttgaaaagtcggtatcacatccagtttgcggaggagctgagtccccatcgagtggtggaccacagggatctggccctcaaggtggaggttcccaaggtggaccatcaggtcagggacaacctaacggcggcatagctgtttcaagcgctgaggacgccgccgccccacagtcaactcgtacgtcaactgcagagggtgaatcgtcgtcctttagtgctgccgcagatgttaatgaaggttctagaaagggcaatgtagctctggctggaagtaccgcttacggtcgttcggtcaccaatgaaaactcctcttctggttctacacaaagtttttcaggtgccgcagaagaaaacgtcgcttcacctgacggtggtagtacccaaagaaatgctgctatcgctggtaatattgcagagggacaagtctcttcaaaagaagaggtggccgaaggtaaggctacctctttatcaggtactatccaagaaagtgacgaaaactcacaacgtagcgccgctattgccggttcctcggccgaagctaacgttgctacacgagagcagacctctaaaggtaagacagccgcttggactggaaactctcaagaaaagtctacttcgccagcagagatttcagagactaacattttctcctctggttcctatgctgagggatctactttatcaagagaaaagttggaacagggtaaatctacaacatggtccgaagaatctgaagagtcccgtaaacacgga

SEQ ID NO: 2219 - DNA, 570 bp, Artificial Sequence
  Description of Artificial Sequence: Synthetic polynucleotide
ggtgcagttgccggtggtgttgctggagcttcgtcgaaggcctccggtaacgaaggtagtggtgctgcttccggtgctaaaaccgtttctgtagcaggcacggacggttccggtggtgccttggctggttcagctgccggagctatttcgaaggcttcaggtgacgaaggttcaggagcagcatccggagctaagaccgtatcggtcgctggtaccgatggcagtgaaggagccgtagccgtaggtgttgcaggagcctcgtccaaagcttccggaaacgaaggttcgggagcagcttctggcgcaaaaactgtgagtgttgccggtaccgatggttctggaggagcccatgccggctctgccgctggagcttcttcaaaagcttccggagacgagggtagcggtgctgcctccggtgcaaagacagtatccgtggctggtactgatggttcaggaggtgctcttgctggcggcgctgccggtgcttctagcgaggcgtcgggtgatgaaggatcaggcgcagcatctggagcaaaagctgtttctgtagctggaacagatggctccgga

SEQ ID NO: 2220 - DNA, 423 bp, Artificial Sequence
  Description of Artificial Sequence: Synthetic polynucleotide
ggttctagcggaagaggattgggtggatacgatggttcggtcgacggaggatacggttccggcagtggttccgccgctgcagcagccgccgccgctgccgcaggatcctctggtcgtggtattggtggatatgacggattcgtagatggaggatatggttcaggaagtggatcggcggcagcagcagcagctgcagctgccgcagcagcaggatccagcggaacaggtttcggcggatatgatggttttggcgacggtggatacggttctggctcaagtgccgcggcggctgctgcagctgctgccgcagccgctggttcttcaggaagaggtttgggaggatatgatggttgggtagatgacggttacggttccggatcgggatctgccgcagcagctgccgctgccgcagctgccgctgca

SEQ ID NO: 2221 - DNA, 426 bp, Artificial Sequence
  Description of Artificial Sequence: Synthetic polynucleotide
ggtaataatctgcatcatcatgatgaatacgttgacaaccatggtcagttggtcgagagatttactactaggaagcattatgaacgtaatgctgctactcgtccacacctttctggaaacgaaagactcgtcgagactatcgttttagaagaggacccatacggccacgaggatatttacgaggaggacgtagttataaacagagttcccggagcttcatcatcagctgcagcagcctcctctgcttccgctggttctggacaaactattattgtggaaagacaggcaagccacggagctggaggtgcggctggtgctgccgctggagctgcggccggttcctctgccagaggtggaagtggtttttatgagactcacgattcttactcctcctacggatcgggctcatcaagcgctgccgccgca

SEQ ID NO: 2222 - DNA, 402 bp, Artificial Sequence
  Description of Artificial Sequence: Synthetic polynucleotide
ggtagcggtgctggaggtgtgggtggtggatatggtggtggtgacggaggctatggatcgggctcatccgcagctgctgccgccgcagctgccgctgcggctgctagcagacgtgctggtcacgaccgtgcatacggtgcgggttccgctgccgccgctgcagctgcagccgcagctggtgcaggagcttctaggccagtaggtatctatggtaccgatgatggattcgttctggatggaggatatgactcggaaggctctgcagctgcagctgctgctgctgcagccgctgctgcatcatcatctggcagatctaccgaaggacaccctttactttcaatttgttgtcgtccatgctcacatagacatagctacgaggccagcagaatcagtgtacacgga

SEQ ID NO: 2223 - DNA, 558 bp, Artificial Sequence
  Description of Artificial Sequence: Synthetic polynucleotide
ggttctggagctggtagagctggtggtgattacggatggggcgacggtggttatggatcggattcggctgcagcggccgctgcggctgcagctgccgcatctggagctggcggaagcggtggcggatacggttggggcgacggtggatatggatccgattcagctgctgctgctgctgcggccgccgctgctgcatccggagcaggaggctctggaggaggatatggttggggagatggaggatacggttccgactccgccgctgcagccgcagcagcagcagcagctgctgcaggaagtggagcaggaggtagaggtgatggcggatatggaagtggctcttctgccgcagctgcagcagccgcagcggccgcagccgctgcaagacaagctggtcatgagagggccgctggtagcgctgcagctgcagcagctgccgccgcagcagctgccgcttctggtgctggaggtagcggacgtggttacggctggggtgacggcggttatggatccgactctgctgcagctgctgctgccgcagctgctgccgctgccgca

SEQ ID NO: 2224 - DNA, 459 bp, Artificial Sequence
  Description of Artificial Sequence: Synthetic polynucleotide
ggttctggtgctggtggcgcaggaggtgattacggatggggagatggaggatatggaagtgattcagccgcagccgccgccgctgctgcagcagccgcatcaggtgctggaggagccggaggtggatacggatggggagacggtggttatggatctgactccgcggcagccgcagcagctgcagcagctgcagctgccggctccggcgctggaggtaggggtgatggaggttacggatcaggatctagtgcggcggctgcggccgctgcagccgctgccgctgccagaagagcaggacatgaccgtgcagcaggtagcgcagctgccgctgctgctgcagctgctgccgctgctgcatctggagctggcggttcaggaggcggatatggttggggagacggaggttacggtagtgattccgctgccgccgctgctgccgctgcggcagctgctgctgca

SEQ ID NO: 2225 - DNA, 1041 bp, Artificial Sequence
  Description of Artificial Sequence: Synthetic polynucleotide
ggtagtggagcaggaggtgttggaggcggttacggatggggagatggaggttacggctccgattcagctgctgctgccgccgctgccgctgccgcagctgctgcttcaggtgccggaggtgctggaggatacggtggttatggatcggactcagctgccgcggctgctgctgcagcagccgccgcagctgcttcttcaggtgctggaggcgcgggtggaggttatggatggggagacggtggatacggttcagactctgccgctgcagcggccgccgcagcagctgcagctgcaggttctggtgctggtggaagaggtgatggaggatatggatctggtagtagtgccgcagccgctgctgcagcagcggctgcagctgccgcttctggtgcaggaggttcaggtggtggttacggctggggagatggaggatatggtagtggatctgctgctgcagctgctgcggcagccgcagccgccgcagctggatctggtgcgggcggagtcggtggaggctacggttggggagacggaggatatggtagtgactccgctgccgctgctgcggcagctgcagctgccgctgccgcatctggagcaggaggtgccggtggctacggcggatacggaagtgattccgctgcggctgcagctgcggccgctgctgccgctgctgctggttccggtgctggtggagcaggaggtggttacggatggggtgatggtggttacggttcagatagcgctgccgcagcggccgcagctgctgcggctgccgcagcttccggagctggaggacgaggtgacggaggatacggaagtggaagttctgccgctgctgctgccgcagctgccgcagcagccgctcgacgtgcaggctatgatagggccgcaggaagtgccgccgctgcagctgctgcagctgcagccgccgccgctagtggtgctggcggttcaggcggaggatatggctggggagatggtggctacggatctgattcagctgcagctgctgccgcagccgccgcagccgctgcggca

SEQ ID NO: 2226 - DNA, 753 bp, Artificial Sequence
  Description of Artificial Sequence: Synthetic polynucleotide
ggttccggtgctggaggtgtgggaggaggttacggctggggagacggtggctacggatctgattcagcggccgctgctgcagccgccgcagcagccgctagtggtgctggaggtagcggcggttatggtggttatggttcagactcagccgctgccgcagcagccgccgctgctgctgctgccgctggtagtggagctggtggtgttggaggaggttatggttggggtgatggcggatatggatctgatagtgcagctgccgcagccgccgcggcagctgcagcttcaggagctggtggttctggaggatatggaggatatggtagtgactccgctgccgccgccgctgctgcagctgctgcagcagcggctggatcaggcgctggtggagttggtggaggttacggttggggtgatggtggttacggcggatacggatcagattctgctgctgcagccgcagcggctgccgctgctgctggttccggtgcgggaggtgttggtggaggctatggcagaggagactctggttacggctccggctcttccgcagcagctgctgccgctgctgccgctgcggccagaagagcaggacatggtagatcctcaggctcagctgccgccgcagccgcagctgctgcagctgcagcagcttcaggagcaggcggttcaggtggtggatatggctgggattatggatcttatggctcggactcggccgccgccgcagctgctgctgcggctgcagctgca

SEQ ID NO: 2227 - DNA, 501 bp, Artificial Sequence
  Description of Artificial Sequence: Synthetic polynucleotide
ggtaaaaaccttagacatcatgatgagtacgtcgataaccacggtcaattggttgagagattcacgacaagaaaacatttcgaacgtaacgcagcaactagacctcacttgtccggtaatgagagactagttgaaaccattgttttggaagaagatccatatggacacgaagatatttatgaggaagatgtcgttatcaaaagagttccaggtgcctcaagttcagctgccgctgcttctagcgcttctgctggatcgggtcaaactattatcgtagaacgccaggcatctcatggagcgggtggtgctgctggagctgcagctggtgctgccgctggttcatccgcaaggaggggaggtggtttttacgagactcacaattcttactcctcttacggttctggttcatcatccgctgctgcaggatcaggagcgggaggtgtcggcggtggttatggtagtgacagtgctgccgccgccgctgctgctgcagctgctgca

SEQ ID NO: 2228 - DNA, 402 bp, Artificial Sequence
  Description of Artificial Sequence: Synthetic polynucleotide
ggttctggcgctggaggatctggaggtggttatggttggggagacggaggttacggaagtggatcctcggctgccgctgccgccgctgcagctgcagccgcaggatctagaagatccggtcacgatagggcctacggagctggatccgccgcagccgcagcagcagccgctgctgccggtgcaggagcatcaagacaagtgggtatttacggaaccgacgacggtttcgtccttgatggaggatatgattctgagggatctgctgctgcggccgcagcagctgctgcagcagccgcttcgagttctggtcgttcaaccgagggacatccattgctgagtatctgttgccgaccatgttcccattcacactcatatgaagcatcaaggatctctgtgcatgga

SEQ ID NO: 2229 - DNA, 558 bp, Artificial Sequence
  Description of Artificial Sequence: Synthetic polynucleotide
ggttcaggagctggaggcgcaggcggtggatacggatggggtgattcaggttatggatctgactcagcagccgcagctgcagcagcggccgcagccgctgccgcctcaggtgctggtggatccggaggctatggtggatatggttccgactcagctgccgccgctgcagcagcggcagcagccgcagccgcaggcgcgggagcgggcggagctggaggatcctacggctggggagatggcggatatggatcggattcggcagccgcagcagctgcagcagcagcagccgcagcaggttctggtgcaggaggaagaggtgatggtggttatggatcaggtagttcagctgctgcagcagctgccgctgccgccgcctctgccgccaggcgcgctggacacgatagcgcagccggctctgctgctgctgcggccgctgcagcagctgcagctgccgcttctggtgccggtggttctggtggtggatatggttggggagacggaggatacggttccgactcggcggcagcggcagctgcagcagctgctgctgccgctgca

SEQ ID NO: 2230 - DNA, 558 bp, Artificial Sequence
  Description of Artificial Sequence: Synthetic polynucleotide
ggtagtggagccggaggtgccggaggaggttatggctggggtgatggtggatatggttcagacagtgcagctgccgcagccgcagccgctgccgctgctgctgcttccggagctagaggtagcggaggttacggtggttacggatcggatagcgctgctgctgctgcagctgcagcagcagcagcagccgctggaagtggtgctggtggtgttggaggtggttatggttggggagatggtggttacggatctgatagtgcagctgccgctgcagcagccgccgccgctgcggccggaagcggtgccggcggaaggggtgacggaggatacggttccggatctagtgctgcagcagccgctgcagctgctgctgctgccgcgagaagagctggtcatgaccgggccgcaggttcagcagctgctgccgcggctgcagcagctgccgccgcagcttctggcgctggtggatcaggtggtggatatggatggggagatggaggatacggtagcgattctgcagctgctgcggcggctgctgctgctgcggctgcagcagca

SEQ ID NO: 2231 - DNA, 747 bp, Artificial Sequence
  Description of Artificial Sequence: Synthetic polynucleotide
ggtagcggtgctggtggacgcggcgacggaggttacggttggggagatggtggatatggttcagattctggtgcagctgctgccgctgcagctgccgctgcggcagctgcatctggtgcaggcggaagaggtgatggaggttatggtagaggtgacggaggatatggaagtgatagtgctgctgcagcagcagccgcagcagcagccgcggcaggatctggagcaggaggtcaggcaacggttgttatggacggtgctatggccgcaatggttttaactagagcccaacaacaattagcggctgcagccgcagctgcttcagccagtggagctggtggatctggcggaagttatgaatgggattacggaagttacggatcagattccgcagccgcagcagcggctgccgccgctgccgctgctgccggttctggtgctggcggtgtgggtggtggatatggtcgtggtgatggtggctatggctctgatagtgctgccgcagccgcagctgcagccgccgcggcagcaggatccggtgctggaggaagaggagatggtggttatggatggggagatggcggctacggctctgattctggtgctgcagcagctgcagcagcagctgctgctgctgcagccagcggtgcgggaggcagaggcgacggtggttacggatggggagacggaggatacggatccgaccctggagctgccgctgctgctgcagctgctgctgccgccgctgca

SEQ ID NO: 2232 - DNA, 378 bp, Artificial Sequence
  Description of Artificial Sequence: Synthetic polynucleotide
ggtaagacacttaaccatattggactacatcctaaaggcaacacgcgtattgatgagtatgtggataaaacaggtcagctgtatgaaagatacacgaccagagaagagttcgaaaggaacgccgctactttaccacacttgtcccgcaacgaaagattgttggaaacgatcatcatcgaggaagatccatcaggtcatgagaaaatatataaagaggatgtcgttcttaaacgtgttcctggagcttcttctgccgcttctgctagtagcgctgccgccgctggttctggttccagaagattaggcaggttgcatggatgggatggcggtgcttacggctccgattcagctgctgcggctgccgctgcagctgccgca

SEQ ID NO: 2233 - DNA, 612 bp, Artificial Sequence
  Description of Artificial Sequence: Synthetic polynucleotide
ggttccggagctggtggcttaggcggtctgtacggattacacggaggatattacggatcagactctgcagcagctgccgcagccgctgccgctgcagcagccggatccggagctggtggtcttggaggactctacggtttgcatggaggagtttatggttccgacagcgctgctgctgctgctgcagccgccgccgcaacagctggttctggtgcggaaggattaggaggtctgtacggactccacggaggatattatggtagtgactctggagctgcagcggccgctgcagctgcagcagctgctggtagtggtgctggtggtttgggaggacattatggactgcacggaggcgtgtatggttctgacagtgcagctgctgcggccgcagccgcggccgcagctgcaggttccggtgctggtggtttaggaggattgtatggtctacacggaggagtttatggatcctccagttcgcgtagagactcttcttccgctagctctgctgccgccgccgctgcggctgccgcaggaagctccgccgcatctagcgaaagagtctacgaatccgagtcagcagcagcagcagctgccgcggcagcggcagctgca

SEQ ID NO: 2234 - DNA, 714 bp, Artificial Sequence
  Description of Artificial Sequence: Synthetic polynucleotide
ggtagcggctcaagaggtctgggtggactctacggttgggatggtggagtctacggttccgacagcgccgccgcggcggccgctgccgccgctgctgccgctggatctggtgtttctggtttaggtggtttgtacggatgggatggtggagtgtacggtagtgattccgcagctgcagccgctgcagcagccgccgcagctgccggttccggatctcgtggcttgggaggattatacggatggaatggtggtgtctatggatcagattctgccgcagccgcggctgcagctgccgctgcagcggcaggttctggcgtctctggacttggtggactttatggatgggataggggagtgtacggttctgacagcgctgctgcggctgctgccgcagctgccgccgctgccggctcaggttcaagaggattaggtggattatacggttggaacggtggcgtctatggatccgattctgctgctgccgctgccgccgccgcagcggctgctgcaggctctggtgttagcggattgggaggtctgtatggatgggacggtggtttatacggtagcgattcggctgccgcagccgctgcagccgctgctgcagctgcaggtagtggagtatcaggactaggaggcttgtacggatgggacggcggtttatacggaagtgatagtgcagccgcagcagctgctgctgcagcagcagcagca

SEQ ID NO: 2235 - DNA, 714 bp, Artificial Sequence
  Description of Artificial Sequence: Synthetic polynucleotide
ggttctggagctggaggtctaggaggtctatacggttatcatggtggtgtctatggatcagatagtgctgccgctgccgcggccgccgcagcagctgccgctggttcaggtatttcaggattgggtggtctttacggatgggatggaggcctctatggttcggatagcgctgccgccgctgctgctgccgcggcagccgcagcaggttctggctctagaggattaggtggcctatacggatgggatggtggcgtgtacggatctgatagtgccgctgcagcggccgctgctgcggcagctgccgctggatccggatctcgtggactgggtggcctctatggttgggacggaggagtttatggatccgattctgcggcggcagccgctgcagcggctgctgctgcagcaggatcgggagtctctggactcggtggcctttatggatgggatggaggactgtatggatccgattcctcggccgcagctgcagcggcagctgccgccgctgccggttcaggctctaggagattgggcggattgtatggatgggatggtggagtttacggctctgattctgcagctgcagctgctgctgctgccgcagcagctgcaggttccggtgtaggtggactgggaggattatacggttgggatggaggagtttatggtagcgattctgctgcagctgccgcggcagcagccgccgctgccgca

SEQ ID NO: 2236 - DNA, 408 bp, Artificial Sequence
  Description of Artificial Sequence: Synthetic polynucleotide
ggtcaatacattgacgatgacatttaccgtctgaagcgtacttacggcgaaacttctaatactcgttccgatgaatacgacgttgacaagttcggaagattatatgagcgaacaaccactcgtaagaagttcgaaggtaactcaaaagtatctccttacattagtggagatgagaaggttgtggaaactattgtttatgaaaacaacccagtcggtcgaggaactatctatgaagaggacgtcgttatcaaaaaggtacctgacgaaacgtctattggaacagctgcttcttcagcatctgctggtgctggactcggcatagctccaacaatcatcgttgaacgtcctttcgaaaattacggtggcggtgctgctgccggtgcagccgctgcagctgccgcagcagca

SEQ ID NO: 2237 - DNA, 552 bp, Artificial Sequence
  Description of Artificial Sequence: Synthetic polynucleotide
ggttcgtctggtgttggttacgaaaggggatacggttctgactctgctgctgcggcagccgctgctgcagcggccgccgcggctggatctggatctagaggtcttggaggttactacggagatggattgttggatggaggctacggtagtggatccgccgctgccgcggccgccgcagctgctgcagctgctgattccggtagtagaggtttaggcggatattatggagacggcctgctagacggagaatatggatcaggctcagctgcagccgctgccgctgccgctgctgccgctgcaggatcgtcaggagtaggttatggtcgtcgttatggaagcgattctgctgccgctgctgcagcagctgctgctgcagcagcaggttcatcaagcgactacacagtgtatgaaagctctagacggggatccagctcttcagccgcagccgcagccgccgccgccgcagccgcaggttcaagcgaagctggttacgaaagaggttacgaatcggattcagctgctgcggcggctgccgccgcagcagctgccgca

SEQ ID NO: 2238 - DNA, 786 bp, Artificial Sequence
  Description of Artificial Sequence: Synthetic polynucleotide
ggttccggaactaggggattgggtggatactacggtaaagatggtggtttattgttagatggagagtatggttccggatcagccgctgctgctgccgctgctgccgccgccgcttctggaagccgtggcttgggtggtttttatggcgacggacttctggatggaggctatggttctggctctgccgccgctgccgccgcagcagccgctgctgcaggatcaggaagtagaggattaggaggtttttatggtgacggactcttggacggaggatatggttctggttctgcggcggcggcagctgcggctgctgcagccgcaggcagtggatctcggggattgggtggctactatggcgacggaatattggatgacggttacggttctggttcggctgccgctgccgctgcagctgcagcagccgctgccggatctggctcaagaggacttggtggctattacggagacggacttttggacggtgagtatggttctggtagcgccgcagccgctgccgcagctgcagctgcagccgcaggatcgtccggagttggatatggacgtagatatggttctgattccgcagcggctgcagcagcagccgcagcagctgccgccggttcttcgtctgactacactgtttacgaatcttcacgaagaggatcatcatcttccgcagcagctgctgcagcagcagctgctgctgctggtagttccgaagctggttatgaacgtggatatgaatctgatagtgctgcggctgcggcagctgcagcagctgccgca

SEQ ID NO: 2239 - DNA, 567 bp, Artificial Sequence
  Description of Artificial Sequence: Synthetic polynucleotide
ggttccggaagtagaggcctgggcggtttctatggcgacggattactggatggaggatatggcagtggttctgctgcagcagctgctgcagctgccgctgcagctggtagcggctccagaggtctgggaggttattatggagacggtttacttgatggcggctacggatcaggatcggctgccgccgctgctgcggctgctgctgctgcaggatcaggttctagaggattgggtggctattacggagacggattgttggatggtgagtacggatccggttcagctgccgcagctgcggccgctgcagctgctgctgagggatcatcaggcgttggatatggtagacgttacggtagcgattctgctgctgccgctgcagcagccgctgccgctgccgcaggatcctcctccgattatactgtgtacgaatctagtagacgtagaagttcaagtagtgcagcagcagccgcagcagctgcggctgcagcaggatcttccgaggcaggttacgagagaggctatgagtctgattctgctgccgcagccgccgctgctgccgcagctgca

SEQ ID NO: 2240 - DNA, 663 bp, Artificial Sequence
  Description of Artificial Sequence: Synthetic polynucleotide
ggttctggttcaagaggacttggcggattctatggtgacggtttgcttgatggaggttatggttctggttccgctgctgcggctgccgctgctgcagcggctgctggctccggatccagaggattaggaggttattacggtgacggtttattagacggtggatatggatctggttcagcagcagcggcggctgccgccgcagccgcagccggttctggcagtcgtggccttggaggatactatggagatggtctattggatggtggatacggctctggaagtgctgcagctgcagccgctgcagctgcagctgccggttctggaagtggtggcttaggtggctactacggtgatggtctgttggacggagaatacggatcgggttcggctgcagctgcagcagcagcggctgctgctgccgagggctcatcgggtgtaggatatggcagaaggtatggttctgactcagcagctgctgctgctgcggccgcagctgctgcaggatcctccagtgactattctgtctataaatcatccagaagagaaagttcctccagtgcagccgccgcggctgctgcggctgcagccgccggctcatccgaagcaggctacgaaagaggatacgagtccgactctgccgcagcagctgcagctgctgcagca

SEQ ID NO: 2241 - DNA, 618 bp, Artificial Sequence
  Description of Artificial Sequence: Synthetic polynucleotide
ggtgatgctattgatgacagtctattaaatttcaataatgaaaacttcattgaaatcggtgagtcgactaccgctgaagttgatgtagaaaacggcactctagtagaaagggaaaccacccgtaaaaaatacgaacgtgacggtgatataacccctaatatctcaggtgaagataaaatcgtgagaacttttgtcatagaaacagatgcttctggtcatgaaactgtctacgaggaggacgtcgtcattaaacgtaagccaggccagcaaggtgtgactgagcgtacaactataggccgtagacaaactggtataagtgccgcaccagtgcctgcccctagttcccaggctccaaccgtcgttgttgaatccaattcacctatcgcgccagcgccagttagtggacctgtttccatcggtcctcaattgggcgccgttggcccttacggtccatcaagaagctcaaccgcaacaaccacctctggtaccggtgttgttcagcaaatccgtactgacagcactggttcatcagcggcttcagctgctaccggcgcttcttccgtagctccagttattgttatcgaggacggtagcagcgccgcgtctgctgcagctgca

SEQ ID NO: 2242 - DNA, 306 bp, Artificial Sequence
  Description of Artificial Sequence: Synthetic polynucleotide
ggttctggagcatccggtccaggaggactgggtctgggcggcttaggcccgtatggcggaattggccctaacgtggtgtccgcagcaagcgcccctgtcgttggaccttctgtgagctcagtcggacctgttggagcccaggtgatcgagatcggttctccagttgtgccatccgtgagcagaactggcagtgtttctagagtttcagtctctggtagacctggagtcagagtcccgtgtagtcttacaagaaggcaatttgtcgtcaaaattggtactaggagacaaccatgtggttattgctca

SEQ ID NO: 2243 - DNA, 1440 bp, Artificial Sequence
  Description of Artificial Sequence: Synthetic polynucleotide
ggttcaggtgcaagtggtgtgggcggattgggactgggtgcattgggtcctttaggtggtattggtcaatcaggagtctcttcagctaccacgtcgggagcaggcctaggtggtgtgggagccgtgggagcctcgggtttaggtggtcttggtggagctggagcttctgctgctggatccgctggagctggactcggtggagtaggagtgggtggatcctcaggatcatctgctgcatctgccgcatctggcgctagcggtgcaggcgaggttatattaattgatgatcgttcttctgctgcttccagggcagctgctggttccggagcttccggtgtgggaggtttgggtttgtcaggattgggtccaatcggaggtattggaccaattggtgccacaagtgcctctacttctggtgccggtcttggtggtgtcggagctgctggcgcctctggcttgggaggtctaggaggcgctggtgcaagtgccgctggttctgcgggtgctggattaggaggtattggagcaggaggatcatcaggctcgtcagctgcatccgcagcatccggtgcctctggtgctggtgaagtaattgtgatcgacgatagatcatcggccgcatccgctgccgcagcatcttctggagcatcaggtctgggtggtctaggacttggaggactcggaccttatggtggtataggtttaaatggtgtttctagcgcatccgctctaggcgctggacttggcggagttggaactgcaggagcttctggcctgggtggtttaggaggagcaggagttagtgcagttggacctgccggtgcaggcctgggaggcgttggtgccggaggatcgtcaggatcttcagcagcctctgcagcctccgccagaagtggtccagcgccagttatcgttattgaggacggtagttctgccgcatctgctgcagctgctggtagtggagcatcgggcttaggtggtctaggcctcggagcgtggggacctttgggtggtataggacctaacgaggtttcttccgcttccgctactggaagtgcagctggatccactggtgcaggtttgggaggttccggtgcagctggtagtagtgctgccagtgctgctagtggcgctgctggtccagctccagtaatagtgatcgaagatggatcctctgcagcttccgcagctgccgctggaagtggtgcatcaggcctgggcggtcttggtttaggcgctatgggaactcttggtggtattggaccgaatggtgtgtctagcgcttccgccacgggttcagccgcaggatctatcggcagcggactttgcggcagtggtgcggcaggttccagcctggcttcagcggcttccggtgctgctggagcagcaccagtcattgtcatagaggatggatcatcagctgcctctgccgcagctgca

SEQ ID NO: 2244 - DNA, 1683 bp, Artificial Sequence
  Description of Artificial Sequence: Synthetic polynucleotide
ggttctggagcatccggtgtcggtggattgggtttgggagctttaggtccactgggtggaataggtcctatcggtgcctcttccgctggtgcttccggagctggattgggtggtgttggagcagctggaacatctggccttggtggtatcggtggagtcggagcttcaaccgctggatccgctggcgctggtttgggaggtataggagccggtggttcgtcgggatccagcgctgcgtccgccgcatccggagctagtggtgccggtgaagttatagttattgatgacagatccagtgccgcatcggcagctgcagctggctctggtgctagtggccccggaggcctcggattgggagtctggggtcctttaggtggtataggaccaattggagcttcatccgcatctgcaagcggagctggtttaggtggagtgggagccgccggcacttccggtttaggcggattgggcggtgctggtgcatctgcggctggatctgctggtgctggtttgggtggtattggagcaagtggttcctcaggatcaagtgtcgcttcagctgccagtggtacttcaggagccggagaggtgatcgtaattgacgatagaagctcggctgcttcagccgctgcagctggctcaggagcgtctggacttggcggtctaggtctgggtggactcggtccatatggtggaattggtctaaacggagtgtcgtctgcttccgctctaggcgctggattgggtggagtcggtacggcgggagcttctggcttaggtggacttggaggaaccggcgcctcggcagctggtagtgccggtgctggcttaggaggcgttggtgctggaggttcttttggttctagtgcagcctccgctgctagtggagcatcgggtgctggtgaagtgattgtaatagacgatagatcttcagccgcaagtgctgctgcagctggttccggcgccagcggtccaggcggcttgggtttgggtgtctggggacctctaggcggtatcggtccaaacggtgttagttccgccagtgccactggttcggccgccggatccaccggagctggtctaggaggatctggtgcagcaggttcaagcgctgccagtgctgcctcaggagctgccggaccagctcctgtcattgttatagaggatggttcaagtgccgcctcggcagctgctgctggttccggtgcaagtggtctaggtggattgggtctgggagcctggggtcctcttggtggaattggacctaatggagtctcctctgcttcagcaacgggatctgccgccggatcaactggtgccggtttgggtggctcaggagcggctggttccagcgccgcttcggcagcatctggagccgcaggacctgctcctgtgatagtcatcgaagatggttcctcagcagctagtgctgcggccgccggttcaggtgccagcggtctaggaggcttgggactaggtgcatggggacctttaggaggaatcggacctaatggtgtttcatcagcttcagctacaggatctgccgccggcagtactggagctggtctgggtggttcaggagctgcaggctcctcggcggcatcagccgcttctggagccgcaggtcctgctccggtgattgttatagaagatggttcatctgcagcctccgcagccgcagca

SEQ ID NO: 2245 - DNA, 393 bp, Artificial Sequence
  Description of Artificial Sequence: Synthetic polynucleotide
ggtaatattaatgatttcgatgaggattacttcggttccgacgttaccgtccaaagttcaaatactacggatgaaatcatcagagacgcatctggagccgtaatcgaggaacagataaccacaaaaaaaatgcaacgtaagaacaaaaatcacggtatccttggcaaaaatgagaagatgataaaaacttttgttattaccaccgactcggacggtaacgaaagtattgttgaagaggacgtgcttatgaaaacattgtccgatggtactgtggcccagtcatacgttgccgctgacgcaggagcctattcgcagtccggaccttatgtcagcaactccggttactcaacacatcaaggttacacttctgatttcagtacctccgctgctgta

SEQ ID NO: 2246 - DNA, 450 bp, Artificial Sequence
  Description of Artificial Sequence: Synthetic polynucleotide
ggtgctggtgctggctccggtgctgcttccggagctggtgccggtgctggtgctggtacaggctcatcaggatttggaccatatgttgctaacggaggatactcccgaagagaaggttacgaatatgcatggtcctctaaatctgacttcgagactggttccggtgccgccagtggagcaggagcgggcgccggtagcggtgcaggagctggatctggcgctggtgcaggctctggagccggcgcaggttccggcgcaggcgccggtggtagcgtgagctacggtgctggtagaggttacggtcagggcgcaggctctgcagcctcttctgtgtcatctgcatcgtctagatcatatgattattcccgcagaaacgtcagaaaaaattgcggaatccctagacgccaattagtggttaagtttcgagccttgccatgtgttaattgcgga

SEQ ID NO: 2247 - DNA, 1209 bp, Artificial Sequence
  Description of Artificial Sequence: Synthetic polynucleotide
ggtgcaggagccggttcgggtgcaggagcaggttccggagccggcgcaggttctggagcaggagcaggttcgggtgctggctacggtgcgggagtgggagcaggctacggtgctggttacggtgctggtgctggagctggttatggtgctggtgctggctctggcgctggtagtggcgcaggcgccggatctggtgcgggcgcaggttcaggtgccggtgctggatccggtgcaggagcaggatccggtgctggtgccggctctggtgctggtgctggtagcggtgccggagcaggatcaggagccggtgcaggatcgggagcaggagctggatacggagcaggctacggcgcaggagctggagctggatatggagccggagctggcagtggtgcaggttcgggagctggcgcaggttctggtgccggtgccggttctggtgctggagccggttctggagctggagcaggttcaggagctggagctggttctggtgcaggcgcaggctccggtgcgggtgccggctctggagccggagccggatacggtgctggagttggagcaggttacggtgccggttatggagcaggagccggagccggttacggagctggtgctggttcaggtgctggatccggtgccggtgctggttctggagctggtgccggttccggagctggagccggctcaggtgctggtgttggatcgggagccggtgctggctccggagcaggagctggttccggtgccggagcaggtagcggcgccggagcaggatacggtgcaggatatggtgccggcgctggtgccggatatggcgctggtgcaggatccggagcaggctcgggtgctggagctggatccggagccggtgccggaagcggcgctggcgccggttctggagccggcgctggaagcggagctggtgccggatctggagctggtgctggaagtggtgctggtgcaggttctggtgccggagttggttacggagcaggagttggcgccggatacggtgctggctacggcgctggcgccggagctggttacggagctggcgcaggatcaggagcagcatcaggtgctggtgccggtgctggagctggtgcaggtacaggttcctctggttttggtccttacgtcgctaacggaggatactccggatatgaatacgcttggagttctgaatcggattttggcacgggctca

SEQ ID NO: 2248 - DNA, 957 bp, Artificial Sequence
  Description of Artificial Sequence: Synthetic polynucleotide
ggtgctggagctggttctggagctggagctggtgcaggagctggcgctggaagcggagctggagctggttatggagctggtgtcggagcaggttacggagctggatacggagctggtgccggcgccggttacggtgctggagccggatctggcacgggttccggtgctggagcaggatctggtgctggtgccggatacggcgctggcgttggagctggatacggcgcaggcgcaggaagtggtgctgcttttggtgctggtgcgggcgcaggcgcaggttccggagccggtgccggctcaggtgctggtgctggttccggagccggagcaggcagtggtgccggcgcaggatctggtgcaggagctggatatggtgccggttatggtgccggagttggtgcaggatacggagccggtgccggtagtggtgcagcttctggcgctggcgcgggatctggtgctggagctggaagcggcgcaggagctggttctggtgctggtgcaggatcaggagcaggagctggatctggagctggtgcgggctacggagccggagttggtgctggttatggtgctggttacggagctggcgctggagcaggatacggtgccggtgccggctccggagcagcttcaggtgcaggcgctggttcaggagccggcgcaggagcaggatcaggagcgggcgctggatccggcgctggcgccggttccggtgcaggcgccggaagcggagcaggttccggtgccggcgctggttcgggagctggtgccggatctggagccggtgctggatatggtgctggtgccggttcgggtgcagcttctggtgccggagccggagccggtgctggagccggtacaggttcttccggtttcggaccttacgttgcaaatggaggatactccggatacgagtacgcgtggtcctcagaatccgattttggaactggttca

SEQ ID NO: 2249 - DNA, 1173 bp, Artificial Sequence
  Description of Artificial Sequence: Synthetic polynucleotide
ggtgccggtgcaggatcgggagctggcgctggatctggtgcaggagccggatatggagccggttatggtgccggagttggagcaggttacggtgccggtgcgggcgtaggatatggtgccggagctggtgcaggatacggagctggagctggctcgggtgctgcaagcggagctggagccggtgccggtgctggtgcaggatccggagctggagcgggttctggtgctggtgctggcgcaggctcaggtgctggtgccggatatggagcgggatacggaattggtgtgggagctggctacggtgccggtgctggagtcggttatggtgctggcgcgggagctggatatggcgcaggagccggttccggagccgcttcaggtgccggtgccggtagcggtgcaggcgctggatcaggagccggtgctggctctggagccggtgcaggttctggagccggtgccggaagtggagccggtgccggatcaggcgccggtgctggatacggagctggatatggagctggtgtgggcgcaggttacggagctggtgctggtgttggttacggtgctggtgccggtgcaggatatggtgctggagcaggttccggcgctgcttcaggtgctggagctggtgctggagccggtgctggagctggttcaggcgcaggagctggatcaggagccggcgccggatcaggagctggtgctggttctggtgctggagctggaagcggagccggcgctggttctggagctggagctggatctggtgcgggcgcaggatcgggtgccggagcaggctcaggagctggcgccggatacggagctggtgtcggtgctggttacggagctggttatggcggtgcgggtgcaggttatggagctggagcaggttctggagctgcttctggtgctggtgcgggctcaggagctggagctggatccggagccggtgctggatctggcgccggtgcgggatcaggtgcgggtgctggaagtggcgcaggcgctggctatggagctggcgccggcagtggtgccgcttctggtgcaggcgctggagccggagcaggcgcaggtacaggttcttctggtttcggtccatacgttaacggtggatattccggatatgaatacgcgtggtcatcggaatctgactttggaactggatca

SEQ ID NO: 2250 - DNA, 507 bp, Artificial Sequence
  Description of Artificial Sequence: Synthetic polynucleotide
ggtgcagatattttggaaactggtattcttggaggcaatgtccgcgaggtttctgaatcgactactgataattttaccactgatggtaatggtaacgtgaccgaagtaaaaacaacacataaagaattccgcagacaaggtgaggttcctaacaatatttcaggagaggacaaactcgtcagaacttttgtaatcgaaaccgacgcatcgggaaacgaggtcatatacgaggaggatgtagttatccataaggttcctggtactagtgcaactacaaagactactaccgctagaaggcaacttggtggtatcggtggtacaggagcagcctcctcttctgccgcaactagtcctcctcggcctactagtccatatggtccaaatggttcctctagtgcagctacttcttctgcttccggttccgccccagttattgtcattgaagagaatcagagctcggctgccgccgctgcttcttcttccagctccggaccaaatggactccta

SEQ ID NO: 2251 - DNA, 570 bp, Artificial Sequence
  Description of Artificial Sequence: Synthetic polynucleotide
ggtccatacggaccaaatggttcgagtgcttcaagcgcagcttcttccggagctgcaggagctggtggccttaacggaatatacggtagtaacggtgctttgttgagcggcgctgcaggcgtcaacggtttaaacggtctttacggcccaaacggcagttctgcttcttctgcaggagccgcaggaattggtggtctaaatggattaaacggttcaaacggatcttcctcggccgctagttcttcagcttctggctctggaccagtaatcgtgatcgaggaaaaccaatcttctgctgccgctgccgcctcctcttctagttcgggaccaaacggtttgttgggtccttacggtcctaatggatctgcggcttcaagtgccgcagcaagtaatgcaggaaataacggtcctgtagttattatagagaggggatcctcttcatccgcagctgcgggttcatcatcatctgccccttacgtccttccaggtgtccgtggaccttgtcgactaaccaggagacagttcgtagtgaagataggatctagacgacaaccttgtcttacttgttca

SEQ ID NO: 2252 - DNA, 684 bp, Artificial Sequence
  Description of Artificial Sequence: Synthetic polynucleotide
ggtccatacggtccaaatggttctgctgcatcgtcagcagctgcaagtggagccgctggagccggtggcctaaatggattatatggatccaatggcgccttattgtccggagctgcaggagtcaatggtttgaatggtttgtatggacctaatggttcatcggcttcatccgctggtgccgccggcattggcggtttaaacggtttgaacggcagtaatggatcagcatctgccgcatcatcctcagctagcggtagtggacctgtcattgtaattgaggagaaccagtcgtccgccgcagcagccgcctcttcatcaagttcaggacaaaatggcttgcttggaccgtacggtcctaacggaagttctgcttcctctgcagcctcctctggtgctgccggcgccggtggtcttaatggtatttatggatctaacggtgctttgctctcaggtgctgcaggagcaaacggcgttaacggtctgtatggtccaaacggatccagcgcatcttccgccggtgctgcaggaatcggcggactcaatggcctaaatggttcaaacggttccgcttctgcagcttcatctagcgcttctggaagcggacctgtaattgttattgaagagaatcaatccagcgccgctgctgcagctagttcctcctcttctggccctaacggattgcta

SEQ ID NO: 2253 - DNA, 684 bp, Artificial Sequence
  Description of Artificial Sequence: Synthetic polynucleotide
ggtccttatggacctaacggtagtgcagcttctagtgccgccgcctcaggcgctgccggtgctggaggtctgaatggtctttatggttccaacggtgcattgctgtccggtgctgccggagttaatggcttgaacggcctatatggacctaatggttcgtctgcgtcctcagcaggcgctgcaggaatcggaggattaaatggtctgaacggttcgaacggatcagcttctgctgcctccagttccgcatctggaagtggaccggtaattgtaatagaagaaaatcaatcttcagctgctgctgccgcgtcatcatcttccagtggccagaatggcttgttaggcccatatggcccaaacggaagcagtgcatcctctgcagcaagttctggagctgctggagctggtggtttaaacggaatttacggctctaatggtgctttgctttctggtgctgccggtgcaaacggtgtaaatggcttgtacggaccaaacggatcaagtgccagctcagctggcgctgccggtatcggtggtttgaacggacttaatggatcaaatggatcagcatcagccgcctcctcgtccgcgtctggatcaggtccagtcatagtaattgaagaaaaccaatcttccgctgccgctgcagcttcttcaagtagttccggtccgaatggcttacta

SEQ ID NO: 2254 - DNA, 924 bp, Artificial Sequence
  Description of Artificial Sequence: Synthetic polynucleotide
ggttacggttcgggttcttccgccgcagcagccgctgctgcagcagccgccgcttccagaagagcaggccacgaaagagctgccggttccgctgctgctgctgcagccgcggctgccgctgctgcctccggtgtgggtagaagtggtggctcatatggttggggtgatggaggctacggatcagactctgccgctgctgctgctgccgcagctgctgcagctgctgctgcttctggagcaggaggagcaggagtatgtagaggttatggtggttacggatctgacggaagtggaagtgcagccgctgcagctgcagctgcggctgctgctggtagtggcgcaggaggcgttggaggaggttatggttggggagacggagcttatggttctgattcagccgccgccgcagcagctgcagccgcagccgccgctggttcaggtgccggtggtagacgcggatacggagcctacggatccgacagcagcgccgcagccgcggcagctgcagctgccgcatccggtgctggtggttctggtggtggttatggatggggagatggtggatacggatccgactcggctgcagcagcagctgctgcagccgctgctgccgctgctgctggttcaggagccggaggtataggtggaggattcggaagaggtgatggaggatacggttctggaagttcagcagcagcagcggctgctgctgcggctgccgctgcgagacgtgctggtcatggaaggtctgctggtagcgcggcagcagctgctgccgcggcagcggccgctgctgctagcggagctggaggatccggaggttcttacggttgggattatgagtcatatggtagcggttctgctgctgcggccgccggttcaggcgcgggaggatctggaggtggttatggttggggtgacgga

SEQ ID NO: 2255 - DNA, 276 bp, Artificial Sequence
  Description of Artificial Sequence: Synthetic polynucleotide
ggtggatatggagcaggaagcgcagctgcagcagcagctgctgcggccgctggtgctggagctagcagacaagtgggcatctacggaactgatgatggctttatcctagacggaggttacgactctgaaggttccgctgccgcagctgccgccgcggccgctgctgccgcctcctcttcaggaaggtctacagagggtcaccctttattgagcatttgttgtagaccatgttcacattcccacagttacgaagccagcagaatgccagtccattca

SEQ ID NO: 2256 - DNA, 468 bp, Artificial Sequence
  Description of Artificial Sequence: Synthetic polynucleotide
ggtgctacgggtgctactggacctcaaggtatacaaggacctgctggagctacaggagctactggtgccacgggtccacaaggccctcagggcattcaaggtccagctggtgccacaggagccacaggtgcccagggtgcacaaggcccagctggtgcaactggtcctcaaggccctcaaggtattcaaggacctgccggtgccactggtgcgacgggagcccagggagctcagggaccagctggagcaacaggtgcaacaggagcaactggtgctcaaggcccacagggtgttcaaggtccagcaggcgccaccggagccacaggagcccaaggtccagctggcgctactggagctaccggcgccactggagctcaaggcccacaaggtgtccaaggaccagctggtgctacaggagcaactggagctcaaggtccacagggagttcagggtccggctggtgctaca

SEQ ID NO: 2257 - DNA, 513 bp, Artificial Sequence
  Description of Artificial Sequence: Synthetic polynucleotide
ggtgctacaggagcacaaggtcctcaaggcattcaaggtccagctggagccacaggtgctactggccctcagggtccacagggaattcagggtccagctggtgctacgggcgcgaccggtgcacaaggtgcgcaaggtcctgctggtgctacaggagctactggtgctcaaggtgcccagggaccagccggcgccacaggtgcaaccggcgccactggagcacagggaccccagggtgttcaaggaccagccggtgcaactggtgctcagggtgctcaaggagttcaaggaccagcaggagctaccggagctaccggcgctcaaggacctcaaggtgtacaaggtcccgctggtgcaaccggagcaaccggtgcccaaggtccccaaggcgttcaaggacctgccggagctaccggagccaccggtgctcagggtcctcaaggtgttcaaggcccagctggcgccactggagctactggagcgcaaggaccacaaggagttcaaggtcctgca

SEQ ID NO: 2258 - DNA, 1020 bp, Artificial Sequence
  Description of Artificial Sequence: Synthetic polynucleotide
ggtctgcaaggtccacaaggaattcaaggtgttcctggtccagtgggtgccaccggtcctgaaggtcctcagggtattcaaggtattcaaggagtacagggtgctactggtccacaaggtccacaaggtattcaaggcatacaaggcgttcaaggaattacaggagcaacaggtgttcaaggtgctaccggtattcaaggcatccaaggagagatcggagctacgggtccagagggtccacagggtgttcaaggtgcacaaggtgccataggtcctacaggtcctatgggtcctcagggtgtacagggagtgcagggaatccaaggagccactggagctcagggtgtgcagggtccacagggtattcagggaattcaaggaccaactggagctacaggcgatatgggtgctaccggagctactggagagggagcaactggcccaactggtgtcaccggaccaactggagtgaccggaccttcaggtggccccgctggacccaccggccctactggtccttcgggaccagcaggagttacaggaccttcaggaggaccacctggtcctactggtgcaactggtgcaacaggaataacgggcgatactggagctactggctctactggagttacgggcgccactggcgaaactggtgccacgggtgttactggcctgcaaggtcctcagggaatccagggcgttcaaggagagatcggtcctactggacctcaaggtgtgcaaggtcctcaaggtattcagggagttaccggcgccacgggtgaccaaggacctcagggtatccaaggtccccaaggagatattggacctactggacctcagggtatacaaggaccccagggatcgcaaggaatccagggtgcaactggaggtaccggtgcacagggtccccaaggaatccaaggtccacagggtgatattggtccaaccggtccacagggtccgaccggtatacaaggaattcagggtgaaataggccctactggaccggaaggccctgaa

SEQ ID NO: 2259 - DNA, 846 bp, Artificial Sequence
  Description of Artificial Sequence: Synthetic polynucleotide
ggtgccacaggcgctacaggacctcaaggtgcgcaaggcccagccggagctacgggtgcaacaggcccacagggtgtgcaaggtaacacaggagcaaccggcgctacaggtccccaaggcgctcaaggaccagctggtgcaacgggtgcaactggtccccaaggtgttcaaggaaacacaggtgctacaggagccacgggtccgcaaggtgcccagggtcctgccggtgcaactggagctactggtcctcaaggtgtccaaggaaacaccggagcaacaggtgccacaggaccacagggtgtccaaggaaataccggtgctaccggagccaccggaccacaaggtgtacagggcaacacaggtgctactggagccacaggaccacaaggtgtccagggaaatactggtgctactggagctactggcccacaaggtgtgcagggacctgccggagcgactggcgcaacaggtcctcaaggagtgcagggaccagctggtgctacaggcgctacgggtccacaaggtaataccggtgctacgggagcaacaggccctcagggtgcacaaggtccagcaggagcaactggtgccacgggtccacagggtgtacaaggtaacactggtgctacaggtgctacaggtccacaaggtgctcagggtccagctggcgccactggtgcaaccggtccacagggtgttcagggtaatactggcgccacaggtgcaactggacctcaaggtgttcaaggtaacacaggcgctactggagccactggacctcagggcgttcaaggtcctgctggtgccactggagctacaggcccacaaggtgttcagggtaataca

SEQ ID NO: 2260 - DNA, 1152 bp, Artificial Sequence
  Description of Artificial Sequence: Synthetic polynucleotide
ggtgctacaggtccaactggtgcaactggtcctactggagctaccggaccaacgggcgtaaccggcccaaccggagttactggcgcaacaggaccaactggtgttacaggaccgactggagccatgggtccaaccggtgctactggtgccaccggtccaacaggagttactggatccaccggtgttacaggtgctactggagctacgggtccaactggagtcactggtcctaccggcgctatgggtcctactggtgctacgggtgcaacaggcgctaccggtgcaacaggtgctaccggagctacaggtcctacaggtgttactggtgctactggtgctacaggtcctacgggtgtaactggagcaacgggcgctaccggccccacaggtgccactggagccactggcccgactggagctactggtcctacaggagctacaggtgctaccggtccgacaggtgccactggtgccatgggtcctaccggtgccactggacctaccggagccacaggacctactggagttaccggttctactggtgcgacgggagctaccggaccgacgggtgctaccggtgcaatgggtcctacaggagccaccggacctactggagcaacaggtccaacaggtgttactggatcgactggagcaactggagccacaggtcctactggtgctacaggtgctatgggtccaacaggagctactggccctactggtgcaaccggaccgaccggagtaacaggacctacaggtgaaactggtgctaccggaccaaccggtgctacaggccctacgggagttactggagctactggccccaccggcgtaactggtccaacgggagccaccggtgcaactggaccgactggagcgacaggtgcaactggtgctactggacctacaggtgttacgggtgccacaggtgttaccggaagcactggtgccacaggcccaaccggtgcaaccggtcctacaggcgcgacaggagccacaggagcaaccggcccaaccggtgttactggtgcaacgggtgccaccggaccaaccggcgtcactggtccaacaggcgctactggagccaccggagccactggagcaaccggagctactggagctactggacctaccggcgtaacgggagctgca

SEQ ID NO: 2261 - DNA, 729 bp, Artificial Sequence
  Description of Artificial Sequence: Synthetic polynucleotide
ggtcctactggagctacgggacctaccggtacgactggtgcaatgggtccaactggagctactggaccaacaggaacaaccggcgcaatgggaccaacaggcgctacgggtcctactggtaccacaggtgccatgggtccaacaggtgctactggtccaactggtacaacaggtgctatgggacctactggagcaaccggaccaaccggtactactggtgcaatgggaccgactggcgccactggacccacgggaacaaccggtgctatgggtccaactggcgctactggacctactggagctactggtcctacgggcgtgactggtagtactggtgccacaggagccacaggagcaactggtccaacgggcgccactggcgccatgggccctactggagcaacaggtcctacaggagctacaggacctaccggagtgactggcgctaccggtccaacgggtgttacaggaccaactggtgcaactggtgccactggtcccacgggtgcaacaggagctacaggcgctactggaccgacaggcccgactggtgtcactggtgctgctggtgccaccggaccaactggagtaaccggtgcaactggtgttacaggtagtacaggagccactggagccactggtgctacaggtgcaaccggtcctactggagtcaccggtgccgctggagctacaggccctacaggtgccgctggcgccaccggtccagca

SEQ ID NO: 2262 - DNA, 630 bp, Artificial Sequence
  Description of Artificial Sequence: Synthetic polynucleotide
ggtggtgcagaggaaaaagccatgaagccctctgagtctccagaatctgctaagaatgaggctggtggcgctgaggagaaggctatgaaaccctcgggttcggctgagtcggctaaaaacgaagctggaggtgctgaagaaaaagaaactaaaccttctgaatctcctgagtccgctaagaacgaggctcgcggtgccgagggaaaggaaaccaagccaagcgagtctccagagtcagctaagaacgaggccggaggagctgaagagaaagaaacaaaaccttctgagtctcccgagagtgctaagaacgaagctggaggagcagaagataaggctatgaagccttctgagtctgctgagtctgccaaaacagaagctggaggagctgaggaaaaggccatgaagccaagtgagtcgccagagtctgctaaaaatgaggctggtggagccgaagaaaccagcatgaagccatctggatcagcggaaagtgctaaaaacgaggcgggaggcgctgaagaaaaggagactaagccctccgagtccccagagtctgcaaaaaacgaggccagaggtgccgagggtaaagaaacgaagccttctgaaagtccagaatcggccaaaaatgaagca

SEQ ID NO: 2263 - DNA, 903 bp, Artificial Sequence
  Description of Artificial Sequence: Synthetic polynucleotide
ggtgattctaacaccgatactaacactgataccaacaccgataaaaatttcgacgccaacactgatagcaatacagattcaaatactgaaacgaacaccgactccaacactgaaaccaacacagattccaacactgatacaaatactgattctaacactgacactaatacagacaaaaataccgacaccaacactgattctaacactgatactaatacagatacaaataccaatacggataccaatacggacactaataccaacacggatactttcacagataagaatactgattctaataccgacacaaacactgatacgcacacagacaccaattcggattccaatacagatactaacaaggacaccaataccgacaagaatacggatacaaatacagattctaacactgactcaaataccgatacaaatacggacactaacacagacactaacactgataaaaatttcgatgctaacactgattcgaacacggactctaatacagacaccaacacggactcgaacaccgaaactaatactgattcaaacacagacacaaacacggatagtaacactgatacaaacacggacaaaaatactgacaccaatacagactcaaacactgatactaacaccgataagaacactgataccaatacggattctaataccgataccaataccgattccaataccgatacgaatactgataagaatactgacacaaatacagactctaataccgacactaacacggattccaatactgacactaacatggatacgaataccgataaaaatactgatacaaagacggattctaatactgactccaatactgataccaatacagactcgaatactgataagaacactgacacaaagaccgattctaataca

SEQ ID NO: 2264 - DNA, 579 bp, Artificial Sequence
  Description of Artificial Sequence: Synthetic polynucleotide
ggtgacatcagagatgcacgtgacgtgcgagacgctcgcgacataagagatatcagagacgcacgagatattcgagatccacgggacataagagacattagagattctagggatattcgagatattagagacgcaagagacatcagagacatgagagatcctcgtgatgttagagatgttagagatcctagagacgtccgtgatgtacgtgacatccgtgatgttagggatgttagggacatcagagactctagggaagtcagagacggtagagacgccagagaagtccgagatatcagggacgcgagggaggtccgagacatcagggacgctagagaagttagagacattagagacgccagggaggttcgagatattcgcgacccacgcgaagtgcgtgatacaagagaggtacgcgacgccagagaagtgagagacgctagagatgctcgtgaggttagagaggcacgtgaagctagagacgttcgtgatgcgcgagatgtacgagatattagagaagcccgtgaagttagggacgttcgagatgctagggaagtaagggatattagagacgttcga

SEQ ID NO: 2265 - DNA, 522 bp, Artificial Sequence
  Description of Artificial Sequence: Synthetic polynucleotide
ggtaaagaatccgacagaagcaaggagagggaccgagagcgcgacagatctagggaaagggacagagaacaaggtcactctagagaaaaggaaagggagcattccaaggaacgtgaccgatctcgcggtcgtgaatctgaccgtggtaaggagtcagacaggggaaaggagagcgagaggggtaaggagagtgagagaggcaaagagtcagaaagaggaaaagagtcggagagaggaaaagagttcgatcgcggtaaagaatctgatcgaggaaaagaatccgatagaggtaaggaatcggatagaggaaaggaatctgaacgaggaaaagaatcagagaggggcaaggagtctgaccgtggtaaagaatcagataggggtaaagagtccgataggggtaaagaaagcgaccgtggcaaggaatctgatcgaggtaaggagtctgatcgtggaaaagaatcagatagaggcaaggaatctgaccgaggtaaggagagcgaccgtggtaaggaatcagaccga

SEQ ID NO: 2266 - DNA, 357 bp, Artificial Sequence
  Description of Artificial Sequence: Synthetic polynucleotide
ggtagaccagagatgtaccctgagggtgttagaccaggaacggtcatttctggtgctgaacgtacttatccaggtggcgtcagacctggcactgttactcctggaactgaagaaatttacccaggtggtgcacgtcccggaacagtgacaccaggcatcgaggagatttacccgggaggtgtacgaccaggaacagttattccaggtgccgaaagaacgtacccaggaggtgtccatcctgacattgtcctaccaggagttgaaaagtcttatcctatagacatccgtccaggcacagttacacctggtgctgatggcatgtatccagaatctgtcagaccaggttcagtaacccca

SEQ ID NO: 2267 - DNA, 672 bp, Artificial Sequence
  Description of Artificial Sequence: Synthetic polynucleotide
ggttctacaacccaaccaggttcgggatcaactacccaaccaggcagtggttctaccacgcaaccaggcagtggatctacaactcagcctggttccggatcgaccacccagcctggatccggctctacgacccaacctggatctggaagtacaacacagccaggtagtggttctactacccagccaggctctggttcgacgactcagccgggtagtggatctaccacccaaccaggaagcggctctactactcagcctggtagtggaagcactacccagcctggatctggttcaactacacaacctggtagtggatccacaactcaacctggttctggatccaccactcagccaggttctggatctactactcagccaggaagtggttctacgacacagccaggatcaggttccacaactcaaccaggtagcggttcaactacacagcctggttctggctccacaactcagcctggctctggttccacaacacaacctggttctggttctacaactcagccaggttccggatcaacaacccaaccgggatccggtagtacaacacaaccaggttcaggtagtacgactcagcctggttcaggatctaccactcaaccaggatccggatccactacccagccgggttctggttccactacccagccaggttca

SEQ ID NO: 2268 - DNA, 480 bp, Artificial Sequence
  Description of Artificial Sequence: Synthetic polynucleotide
ggttctcctagaactacaacaggtggtggaatagcctacccaggtggtatcccgacgactacaacgggaggaggtattgcttacccaggaaacattcccaccactaccaccggaggaggtgtggcttatcctggtaatattccaacaacaacaactggaggtggcacggtttaccctggtggagtccctagtaccacgattacaggttctactgtctatccaggaggtgttccttctacaatcacgggtggtgatgttgcttatcctggagatgttccaagcacaactattactggtaccgtatatcccggaggtgtgtcctctgacggtgcagcttacccaggttctatgcccggcaccacgatcggaggtggcgttacttatcctggaagtattccatctactacgactggaggtggtatagcttactccggttcaatacctggaattacaactggtggtggagttacttacccacga

SEQ ID NO: 2269 - DNA, 630 bp, Artificial Sequence
  Description of Artificial Sequence: Synthetic polynucleotide
ggtgttcctggaactattaccggcgcagatgctgttcatcccgaaggagttcctggtgcaacaaccggattgtcaattacgtatccaggtggcgtacctggtacagtgactggaggagatgttgtccaccctaagtccgcaccaggtactactacaggtagaggcgtcacctacccaggtggtgtcccgggaactgttacgggcggtggcgttgtgaacccaaaaagtgcaccaggaacaactacgggtcatggagtagcatacccaggtggcgttcctagaaccctaaccggcggatccacggtctatcctggaggagtctctggaattactacaggtggacatgttgcttatcctggtggtgtggcagctaccaccataggaggaaacgttgcctatccgggtggagtacctagcacaacaacgggtggtggtgttacatatccgggtggcgtacttggaaccaccacaggtgacggtgctgtttatccgggtggtttacctggaacagctactgtaggaggcattacctatcctggcattattagtggaactacgacaggatctggtatcgcatatcctggtggcgtacccggtacaaccactagcgacgatgttacatatcctgga

SEQ ID NO: 2270 - DNA, 480 bp, Artificial Sequence
  Description of Artificial Sequence: Synthetic polynucleotide
ggtcatcatggtatcccatgggatacgatggaatatccaggaaccccatggaatacgttgggacatcatggcattccgtgggatactatggagtatcctggtacgccatggaatacacttggacaccatggaattccgtgggacactatggagtatccgggaacgccttggaataccttgggtcaccacggtatcccttgggacacaatggagtaccctggtactccttggaatacccttggtcaccatggcatcccatgggacactatggaatatcccggaaccccatggaacactctcggtcatcatggaatcccatgggataccatggagtacccaggtacgccatggaatactctaggtcaccatggcattccatgggatactatggaatatccgggcactccatggaataccttaggacatcatggtattccatgggacaccatggaatatccaggtacaccttggaacacacta

SEQ ID NO: 2271 - DNA, 480 bp, Artificial Sequence
  Description of Artificial Sequence: Synthetic polynucleotide
ggtattcatcaagaggccacttcggaaattcaccctgaagccacttctgagatcccacctgagataacgtccgagattcatcctgaagctaccggcgaaattcaccctgagacgatttcaggaattcaccaggaggccacgtctgaaattcatccagaagccactagtgaaataccaccagagattactagagaaattcatccggaggccacgggagagattcatccggaaaccatatccggtatccaccaggaagctacatcagaaatccacccggaggctacttccgagattccacctgaaatcacctctgagatacacccagaggccacaggtgagatccatcctgaaaccatttcgggaatacatcaggaggcaacgtctgagattcatccagaagctacttccgagatcccgccagagatcactagagaaattcacccagaagccacaggtgaaatccacccagaaaccatctca

SEQ ID NO: 2272 - DNA, 414 bp, Artificial Sequence
  Description of Artificial Sequence: Synthetic polynucleotide
ggtctgcctccgcaaaccacgagagagcttcattcccaatccgcctcagatttgcatcggccctcaacaagtcagatccatagaaggcctactagtaaaattcatccagacccaacttgcgagattcatcaagcctcaacctctgagaagcacccggaagcaacttgtgagatacatccggaatccacatctgagatcttaccagaaaccaccaatgacattcatcgaccatcagccaggcaaatcaaccgaccctcgacaagtgaaataccgcgcgagattaccagggaaattcaccctgaggccacctccgagactcacccagagactactaatgagatacacagaccgtcgacttctcaaatacaccgtccctccaccagccaaattttgcctgagacgaggagcgagtta

SEQ ID NO: 2273 - DNA, 729 bp, Artificial Sequence
  Description of Artificial Sequence: Synthetic polynucleotide
ggtccttggtccaaatgctccaaacactgcggagaaggtggtgaacaatcccgtggtatcaagtgtgaacaagtcatatcgggtggaattccaactgtggttgacgactcccagtgtcttgaaaaagttggtcccaaaggccctaccaagcaagaatgcaacaagaacgttacctgtccacagtttcacgtaggaccgtggaaaccttgtgaccatctttgcggtccaggtaagcaaactcgaaaggttacgtgttacatgaaggtcaacggtaagatacagttgcttaaagatcaagcctgtgagggcgaagtacctaagtctgaaaagccttgtgagctaagaccatgtgccggtcttgactgggttacaagtgactggtctggttgtgacgacaaatgcggtctgactgaagaaactcgtactacatactgcgctacccaagacggaacagtttacccagatgagaaatgtgacgccgaaaagaagcctgagttgactagagattgcgaagctgagaaagactgtgagtttttgtggttcgcctctcagtggtccgattgttctgcaaaatgtggaagtggtgtccagacaaggaaagttttctgtggaaccttcgatgatgagactgtaaaaaaagttccagatgaaaagtgcgacgccgacaaaaaattcaatgaaactaagtcttgtatagcaaaggaggagtgtaagggagaatggttcgca

SEQ ID NO: 2274 - DNA, 390 bp, Artificial Sequence
  Description of Artificial Sequence: Synthetic polynucleotide
ggtgcaacagccgagagcgccgctacaactgagccaggcgctacaactgaatccgctgcaactgaaattaccgagtctacagaatctggagctactgaggttaccgagtccactgaaagtggtgctacgaccgagtctggtgccaccactgagtctggtgctactactgagtcaggcgctactactgaatcaggcgctaccactgagagcggtgctactattgaatccggtgcaacaactgaaagcggcgcgactacggagagtggagctactactgaaagtggcgctaccacagagtccgctgccacaaccgaaccaggtactacgatcgaatccggagcgacaaccgagtccggtgctaccaccgaatccggagccaccactgaatca

SEQ ID NO: 2275 - DNA, 765 bp, Artificial Sequence
  Description of Artificial Sequence: Synthetic polynucleotide
ggtattggtggtcaaacgggtgctggacagccaggttatggttctcagccaggagtggcaggccaaaccggagcaggacaacctggttacggttcacaacctggtgtagctggacagaacggtgctggtcagccaggatacggatcgcaacctggagttgccggtcaaaacgtcgcaggtcagcctggctacggaacacaacctggcattggtggacagacgggtgcgggtcagcctggctatggctcacagccaggtatcggaggtcaaacaggcggtggacaaccaggttacggttctcaacctggaattggtggccaaactggtgctggacaacctggttatggttctcaaccaggtgttggcggacaaactggcgccggtcaacctgaagtcggtggacagactggtgccggacaaccaggatttggagctcaaccaggcattggaggtcagacaggtgccggacagccaggctatggcactcaaccaggaatcggaggtcaaactggtgccggtcaacctggatatggatctcaaccaggcatcggtggacagacaggaggaggacaacctggatatggttcccaacctggaatcggtggacaaacaggtgccggccaaccaggatatggtagtcaaccaggtgtcggtggtcagacaggtgctggtcaacccggttatggatcccaaccaggtgttggaggtcagaccggagctggacagcctggatatggttcgcaaccaggtgtgggaggtcaaaca

SEQ ID NO: 2276 - DNA, 543 bp, Artificial Sequence
  Description of Artificial Sequence: Synthetic polynucleotide
ggtgttggaggacaaactggtgctggtcaaccaggttttggcgcccaacctggaattggaggacagactggagcaggtcaaccgggatacggtacccaacccggaattggaggtcagacaggtgctggacagcctggttatggatcgcaaccaggtgttggtggacagacaggcgctggtcagccgggcgtgggaggtcagaccggtgctggtcaacccggttttggtgcacaacctggcattggaggtcaaactggtgcgggacaacctggatatggtactcaacctggtattggtggtcaaacaggagctggacaacctggttatggtactcagcctggtatcggtggacagacgggatctggccagccaggttacggatctcagccaggtataggtggacaaacgggtgctggtttgcccggttatggaacacaacctggaattggcggtcaaaccggagcaggtcaacctggatacggcagtcaacctggagtcgccggacagacgggagctggtcaaccaggctacggtactcaacca

SEQ ID NO: 2277 - DNA, 816 bp, Artificial Sequence
  Description of Artificial Sequence: Synthetic polynucleotide
ggttatggttcgacgcagactgcaggcggtgattctgcactaacagcaggttatggttctactcaaacagccagggaaggtagtaatctcacagctggctatggctcgaccggaacagccggttcagattctagcctcatagctggttacggatcaactcaaacttcaggagaagattccagcttaactgctggatatggatctacacaaactgctcaagagggatcaaatttgactgctggttacggtagtaccggaacagcaggatcggacagctctttgatagctggatacggaagcacacaaacatcaggaggcgacagttctttaactgctggttacggctctactcagactgctcaggagggatccaatctcacttcaggttatggaagtactggcactgccggagctgattcaagtttgattgcaggatatggttctacccagaccagtggttccgactctgccctgaccgccggctacggatctactcagaccgcacaagaaggatctaatttaaccgctggatacggatcaactggaaccgctggcagtgattcttcgttgattgctggttatggatcaacccaaactagtggttctgatagttcgttgaccgcaggatatggttccacacaaactgcacaagaaggctcgaatttaaccgcgggctacggatcaactggtaccgctggtgttgattcttctctgatagcaggttatggatcaactcaaacatctggttctgattctgctttaacagcaggttacggatctacccaaactgcccaggagggttccaacctgacagca

SEQ ID NO: 2278 - DNA, 450 bp, Artificial Sequence
  Description of Artificial Sequence: Synthetic polynucleotide
ggtgctggattaaatgcaggagctggtcttaatgctggtgcaggtcttaacgctggagcaggcttaaacgctggtgccggactgaaagtcggtgcaggactaaatgcaggagccggtctgaatgtaggagcaggccttaataccggcgccagattttctgccaatgctggtttgaaggcttcagctggactaaatgctggtgccggtctgaacgctggcgcaggactcaaggtgggtgctggtctaaacgctggagccggactgaatgtgggtgctggtttaaacactggtgcaggtttaaacgctaacgcgggattgaaggctaacgctggacttaacgctggtgctggattgaaagttggagccggattgaacgtcggtgctggactaactgccggaactggtttaaatgccaacgctggactgaaggcaaatgctggtttaaatgca

SEQ ID NO: 2279 - DNA, 591 bp, Artificial Sequence
  Description of Artificial Sequence: Synthetic polynucleotide
ggtgtttgcggatgctcaggtggtcgacagctagttaatggagtttgcaaatgcacaggtggccaggaattggttggtggatcgtgtgcttgcacttgcggtcaagagttagtaaacggagtctgtacttgtccaggaggtcaaaaattggttggagacaaatgtatgtgtactggtggacagactatggtcaatgatgtttgtgcctgtactggtggccaaaccttggtggacggagtttgtgcttgtaccggcggccaaaagttggtcgacggagtttgtacttgcactggtggtagaagtttggtcgatggagtgtgcgcttgcacgggtggacagcttttcgctaacgacgtttgtgcctgcccagccttaatgtctctaaagaacggtgagtgctcctgtgacggcggtagagctgaagttcgccctgatgtctgcgagtgcacaggaggacaagagatcgcaaacggtgaatgtgcatgtacgggaggacaaactctcgtggatggtgtgtgccgctgcccttcgctcatgtcgctggaacatggtgtttgtacctgtgatggtggcaggactgaagttagcaca

SEQ ID NO: 2280 - DNA, 516 bp, Artificial Sequence
  Description of Artificial Sequence: Synthetic polynucleotide
ggttccacaactacgtccggaaatggatctggcacctcatcaaccacgaccaacaatggttcgggtgccggctccaccactacctccggtaatgactccggagtgggttcgactactacctctggtaacggttctggagctgagagtaccactaacggcaatgatagtggagtgggctctacaacaacctcaggagctgcctcaacggctacgtcagccaatggtagtggcgccgagtctactaccactagtggaaacggttcaagctctggttccactactacaagtggtaatggctcgggtgcagcttcaactactaatggaaatgactctggtgtaggttcaacaacgaccagtggtgctgcctctactaccacgagtggtaatggatctggtgtcggttctacaacttctagtggtaacggttccggaaccggttcgacctcatctggtattggaagtaccacgacttctgtgaacggtagcggaacaggtactacaaccagctcgggtata

SEQ ID NO: 2281 - DNA, 468 bp, Artificial Sequence
  Description of Artificial Sequence: Synthetic polynucleotide
ggtggtttgggagtgggaggactcggcgttggaggcggattgggtggcggatcgcattactcttcatcctcgtactcttctggtcatggatctggtgtaggcgttggagcaggattggcatcaggagctgctctcggcagtggtgcaggattagctaccggtgcagccctgggctccggagctggtcttgcaagcggagccggtctaggttacggtgcaggtcttgcttcaggagctgcacttggatctggtgctggtctagcaacaggcgccgcccttggaactggtgccggtcttgcctctggcgctgctctgggtagtggagcaggcctcgctactggtgcagctttgggttcaggagcaggactagctgctggtgctggactgggttatggcgccggccatgcctcgggagctgctctaggttctggagcaggactggcttctggagccgctttaggatctgga

SEQ ID NO: 2282 - DNA, 645 bp, Artificial Sequence
  Description of Artificial Sequence: Synthetic polynucleotide
ggtactggtgtttctggaggtccaggttacccaggaaccgtcggagctggacagtaccctggtgtaggcggattgccaggaacttccggacagtacccgggtggccaatacccaggtactggtgccggaggagtcccaggatattctggttaccctggtactagcggagccggtcattacccaggaacgtcaggcacgccaggtgccggaacaggacctggaactggaggtattggtcagcatggtggccagctgtctaccggaactggcgccggcgtaggacatcagggtagtggcgtaggtcaataccctggtacgggtgctactggtggctacccgtatccaggtacaaccggtcagtaccctggaacttctggtatcccaggtgcaggtactggtcaatattacccaggtggtactggagtaggcggtctacctggtggtgttggtcaacacggaggacaattgtccacaggtgcaggaacaggactaggtcaacaaggtggaggagtcggtcaatatccaggaactggcgttggtggtggaccaggatacccataccatcatggtacttcaggtcagtatccaggtggacaataccctggaactggagctgctggaggcccaggatatacaggataccca

SEQ ID NO: 2283 - DNA, 420 bp, Artificial Sequence
  Description of Artificial Sequence: Synthetic polynucleotide
ggtccagctccatatccaacggccccaggtggtgtaggaaagattacctatccggtaggtccaggaggtgttccaggctaccctggaacccccacttatccatcaatccctggatatccaactcctggacacccagtaactgaaccgggataccctggcgtgccatcctatcctggcgctcctagaccaggtgtgccttctggtccatctggtccgagctaccctggtggtcaaattccaggatatcctggtgtcccttccccaggattcccaggaggacctccgcctggatacccaggagtgccaaccgctggttatccaggtattccaacaggcccaggtgttccgtcatacccaggtggaccttccgtgtcatttcccggagttccatcagtgcctccaggagttccgagttaccca

SEQ ID NO: 2284 - DNA, 624 bp, Artificial Sequence
  Description of Artificial Sequence: Synthetic polynucleotide
ggtgcaccatcaccaggttaccctggtgccccaagttcaggataccccggtgccccgtcccctggatacccaggtgccccttctccaggatacccgggtgctccaagtccaggatatcctggagccccatacccaggttacccggaagctcccactccttcatatccaggagctccaactccaggttatcccggtgctcctagtccaggttacccgggagctccagctcctggatatccggaagcaccatacccaggttatcctggtgttccaagcccgggatatccaggagcgccatctccgggttatccaggtgcgccgtcccctggttacccaggtgctcctagttcaggatacccaggtgcgcctagcccgggataccctggcgctccatctcctggttacccaggagccccatctcccggatatccaggagccccttatccaggttaccctgaagctcctactccatcctaccccggtgctccgacaccaggttatccgggagcccctagcccaggatatccaggtgccccagctccaggttacccagaggcaccatatcctggttaccctggagtcccttcacctggataccctggtgctcctagcccaggttatcca

SEQ ID NO: 2285 - DNA, 795 bp, Artificial Sequence
  Description of Artificial Sequence: Synthetic polynucleotide
ggtcttacaggtccagccggtcaggacggaaagcagggtccacagggtcctcgcggtttgacaggtcctgccggccaagacggaaagcaaggacctcagggaccaaggggattgacaggcccagctggtcaagatggtaaacagggaccacaaggtcctcggggtttgactggtccagctggtcaggacggtaaacagggtcctcaaggaccacgtggtttgactggtcctgccggacaggatggcaagcagggaccaagaggactgaccggaccggctggtcaggatggtaaacagggccctagaggtttgaccggtccagcaggtcaggacggtaagcaaggacctcaaggtccacgcggactgacaggtccagctggtcaagacggaaaacaaggaccacagggtcagcctggacaagttggtcctagaggtctacaaggtccccagggtccacgtggagataaaggagagactggaccacagggtccagcaggcaaagacggcgaggctggtgctcaaggtcctgtaggtccggctggtccgcaaggacctcgtggcgataaaggtgaaactggtcctcaaggacctgctggaaaagatggcgaaagaggtcctgttggtccagccggtaaagacggtcaaaatggaaaggacggattgcctggcaaagatggtaaggacggacagaacggaaaggatggtctacctggaaaggatggtaaggacggccaggatggtaaggatggacttccaggtaaggacggtaaagatggacagccaggaaagccagca

SEQ ID NO: 2286 - DNA, 540 bp, Artificial Sequence
  Description of Artificial Sequence: Synthetic polynucleotide
ggtgacaccggacctactggtcctactggcgcttctggtccttcaggtgagactggacctacgggaccaacgggtgtttctggacctagtggagaaacaggtccaactggacctactggtgcctccggtcctagtggcgacactggcccaactggtccaactggtgcttccggaccttcgggcgatactggccctactggtccaactggcgcaagcggccctagtggtgagacgggaccaacaggtccaaccggagcatccggaccttcaggcgagactggtccaaccggcccaacaggcgcatccggtccaagcggtgaaactggtcctactggaccaacaggtgcttctggtccatcaggagagactggtcctacaggtcctaccggtgtatcaggtccatccggtgatacaggaccaacgggaccaactggcgctactggcccttctggcgagactggtcctactggtcctaccggcgccactggtcctagtggtgaaactggtccgactggtccaactggagctactggcccttca

SEQ ID NO: 2287 - DNA, 822 bp, Artificial Sequence
  Description of Artificial Sequence: Synthetic polynucleotide
ggtaaccaaattcttgatcctcgtacgtgcgtttgtaagaagtgtattgctactgcctgtcctgataattcgcattattctttctctacttgtagatgcgaatgtccacaacaccagaagtgccctcatggtcagtactttaattccgagacatgcaaatgtggatgttcccctcatatcaaatgccacagtcctagggtcctgaacaaggatgcttgtaagtgtgaatgcccaaagaacgtacactgtttaccacctttaacttttgatgagagaacatgtgcatgccactgtccagaacaccactcccactgccctacaggtaagatttattcttacacagaatgcggctgtatttgctccgagaaagcttactgtcatcttcctagattttttaacaacgagacttgtaaatgcgagtgtaagggtgaaaggaactgtgtacatcctaaggtctactccgagacgaactgtaattgtcaatgtccagaagatgactactgtccgcggcataagaccattaaccctgaaacctgtgaatgcagttgtccagcagaactcagctgtagaagtccacaagtgctaaacgacaaaacttgcaagtgcgtgtgtccaccacatactagacgatgcccaccaggaaaggagcttgatgatttcacctgtgagtgtagttgtcctgaggttttttgtcctttgccgaagctgcaaaacccttatacctgtaagtgtgcttgccctgataccctgacctgtccttacggacaagttgtagatccagagaactgtcagtgttcctgtccaaaaaaactatcctgttca

SEQ ID NO: 2288 - DNA, 486 bp, Artificial Sequence
  Description of Artificial Sequence: Synthetic polynucleotide
ggtaatcaggatcatggttacggtgtcaggccattagtcgacggtcaataccgcggctctggtactaataacaaacttccgggtaaccagtatcaaggttatggtattacaccttctattgacggacaatacacttctagtggtacaaacaataagttgcctggaaaccaaaatcagggatacggaattaacccttccatagtgggtcaatatccgggattgggcacgaataataatttgccaggaaatcaggatcacggttacggcgttagaccattggttgatggtcaatataggggaagtggaacgaataacaagctgccaggtaaccaataccaaggatacggtattactccttctatcgatggtcagtacacctcctctggaacaaacaataaactgccaggtaatcaaaaccaaggctacggaattaatccttctattgtgggccaatacccaggtttaggcacaaacaacaaccttcca

SEQ ID NO: 2289 - DNA, 495 bp, Artificial Sequence
  Description of Artificial Sequence: Synthetic polynucleotide
ggttcaggcggttcgggtgttcagcagagtggtaacgtaccatctggagttaatatcaatcaaattcaaccatcctatggacaaccgcacggtacactttacagtggtggaaccggtgtgcagcaaccaggctatgcatcttcgggtgaaaacttgaacccgattcaaccttcatatggtcaacctcacggtaccttaggtagcggtggctctggtgttcaacaaagtggtaatgttccttcgggtgtcaacattaatcagattcaacctacctacggccagccacaaggtaccctaggttcaggaggatcgggtgtccaacagagtggtaatgtaccgtcaggaggaaacttaaatccaatacaaccatcctattcccagcctcacggtacactgtatagtggtggtacaggtgtccaacaaccgggttacgctagttccggaggtaacttgaacccaattcaaccttcttacggtcaacctcatggcacctta

SEQ ID NO: 2290 - DNA, 804 bp, Artificial Sequence
  Description of Artificial Sequence: Synthetic polynucleotide
ggtggcgacctccctgataaacctattccaggtggtcaggaagaggttgaaagaccttggccagaaacgggagatcttcctgataagccgattgagactgatcagtttgataccacagctggacctagtttctgggataccactcattctgatcacactgagtcaatggaaatattcgaagttccaccgaatgagattgatgacggtggtgatctgccagacaaaccaatacctggtggacaggtggaacaaccaggaccaggcatcgacggtctgccagataagccaattgagacggatcctttcgacactactactgatggctccttttgggacacaacgcattccgaccataccgagcctatggaaatatttgaagtccctggttcagaaatcgatgatggcggagatttgccagataagccgatcccaggcggtcaggtcgagcaaccttggcctggtccagatgacttgcccgataaacctcttaacattgaccctagtgatacaacaactgattctagcttctgggatactactcactcagatcataccgtgccgatggaggtgtttgaggtcccaccaaacgagatcgatgaaggcggaggattaccagacaagcctataccaagtgatagagatcatgttgagcagcctgagcctgagactggtgacttgccagataaaccaattggaatcaacccttcagatactactactgattcttcattctgggatactacccactttgatcatactgtccctatggaaatcttcgaggttcctccttctgaaatcgacgaa

SEQ ID NO: 2291 - DNA, 1017 bp, Artificial Sequence
  Description of Artificial Sequence: Synthetic polynucleotide
ggtggagttgtgccagtgatccctggaggaccaaatataccaggtggtcctggagatccaataggtcctggtggaccagttgaaccaggaactcctgaaggtccagacggtccgggaataccaggaggtcctaacggtcctggcggaccgggaattactgaaggtcctaatgagagtaatcatcttactactaagatcccaatcactactaccacagatagaaacggaggtggagtagttccagttttacctggcggtccaggtggtcctcgcaaaccaggtggtcctagtggcccaaatggccctggtaatcctggtggacctgttaatccaggtggtccgactggtccagatggacctggaaacccaccaggctctgagacaccaggaggttctggaacgcctattggacctaacggtccagttggaccaggatcaccggatggtccacgtggtccttcaggtcctgatggaccgaaaggtggcacacagaatacaggatcccctagtggtccttctggaccggataacccaaatggacctggaggcccatcgaacccaggtggtccgagtggtccaactggacctgaaggacctgacgaatccaatcggttatcgaccaaaattcccataacctcgaccaccacagatagggttggtggcggtattcctgtgattccaggtggacctaacattccaggtggcccgcgaggacctagcggaccgtccatccctggcgagccagcgggtcctgacggatcaggaggtcctggtggtccagttaatccgggaggtccgaccggtcctcatggtcccggaaatccacccggtccatctattccgggcggacctggaggacctgacggtccaggatcgccatcaggtcctagtggtcctgattctcctggctcgccaaatggtccttctaacacaggttcccctagaggtccatctggtccagatggtcctaaccagcaaccaacatctaaaccggagaagcaaaacgaacaatcttca

SEQ ID NO: 2292 - DNA, 840 bp, Artificial Sequence
  Description of Artificial Sequence: Synthetic polynucleotide
ggtaccaattctactgcaagcggagataattctacagcttctggaactaacgcttccgccaccggtgaaaactctactgcgtcgggtacgaatgcttctgctactggtgagaactctactgctactggaacagcctccacagccagtggttcaaactctactgctaacggtaccaactccacggcatcaggagagaatagcacagctaccggtacggatagcactgcttcaggaagtaattctactgctaatggtactaattctaccgcgtcaggagacaatagtacagcctcgggaactaacgcctccgcgacgggagagaactcgaccgctacaggaaccgattcaactgcatctggttctaactccactgctaatggcacaaattctactgcatccggtgacaattcaacggcctcgggcactaatgcgtctgcaactggtgagaacagcacagctacaggcactgactctaccgcttccggttctaattcgacggctaatggagctaactccacagcctcaggagataattccaccgcttcgggtacaaacgcctccgcaaccggtgagaactctacggctactggcactgattctactgctagcggttcaaatagcacagcgaacggaactaatagtactgcctcaggtaacaattctacggcaagtggaacaaatgcatccgcaacaggtgaaaattctacagcaaccggaacggactcagcagcttccggtacaaactcaacagctaacggtactaacagtactgcctcgggagataactcaactgccagtggtacaaatgctagcgctaccggcgaaaattctactgctaca

SEQ ID NO: 2293 - DNA, 750 bp, Artificial Sequence
  Description of Artificial Sequence: Synthetic polynucleotide
ggttcgggattgagtggagtttctatggctggtagcgaatgttctggagcatcaatggctggatcgggtcattctagagtctcagtcgcaggatctgagtatactggtgcttcgatggcaggcagtggtcatagcagagcctcaggagcaggatctgaatggagtaggactagcatggccggttctggactctcaggcgtttcagtcgccggttctgagtaccctggagctagtatggctggttccggtcactccggtgcccctgtttcaggtagcggatcctccggagcaagcatggcaggatctggactttctcgtgcctcaggtgccggatcagaatgttccagaacatcggttgctggctcaggtcattctagaacgtctgtagctggatccgaatgttcacgggtttcacgagcaggtagcgaatgctccagggcttcggttgccgattctggatactctggagcatctgaggtaggttcaaggtcaagcagagcatctcttgctggattagtacacttcggagcttctattgcatgcagcggtcattctgaagcaagtatggaaggtttggaatgttccggcgcctccgttccagactcaagacattctgtcgctagcgtaacggatggtggtcactctgtagcttccgttgctgactcagtgcatagtgttgttagtatgactggtttaggacagtttgtgtcctccgtttctgaacctggtcatagtactgcctctgttgca

SEQ ID NO: 2294 - DNA, 456 bp, Artificial Sequence
  Description of Artificial Sequence: Synthetic polynucleotide
ggtattgcaactccgagtgataccaactcttatgagtccaccactacagtgactgacatgaccacgtcaacacataccactgtcgttactacaacctggttggtgacaaatagtgacggctctgttgaaaccgagacgggaatcgcgacaccttccgacactaatagttatgaaagtaccactaccgttaccgacacaacctttactacggaaacaaccgttatcactaccacttggttagtgacgaagtccgatggttccgtcgaaactgaaactggtgtgattactcagtcgggtgattcaagtagcactatcactacgtttgagacatcaagtgacacgaacagttacgattcaacaactactgttacggatactaccacaacaacggaaactactgtttttaccaccacatggatcgttactaaatcagatggcagcgtcgaaacagaaaca

SEQ ID NO: 2295 - DNA, 1080 bp, Artificial Sequence
  Description of Artificial Sequence: Synthetic polynucleotide
ggtgaacctactggtagcggttctgaatccaccggagaaccgaccggagagccttctggatcaggatctgaatccaccggtgaaccaactggagaacctacaggagagccatctggttctggatcggaaagtactggtgagccaactggtgagccatctggttcaggttctgaatctgctggtggatccagcactccaggatattctgtttctactaccactgatactactacaactacagagacaaccaccactactactaccaccacatggactgttactaagtcagatggaagtgtcgaaacagaatccggtattgttagtggctctgatagtagtctgacgacaatcactacatttgaaccaccatcgagttcctctggatttggtactgaaagcggcctgattacggatacgaacaacgagtcatctgcgggatctactggtggcgcctccgagccgactggaggtgcctcggagtccaccggtggagctagtgagcctacaggagaacccacaggtggagcctccgaaagcacaggtggtgcatcggagccaaccggtgaaccaagtggtggcgcctcagaaagtactggaggagcaagtgagccaaccggagagccaactggaggtgcaagtgaatcaactggtggtgcatctgaaccaactggtggtgcttccgagagtacaggaggtgctagtgaacctacaggaaacggttccgaaagcacgggtgaaccaactggcgagccgacaggtggtgcctcagaatctactggaggagctagtgaaccaacgggagagccaacgggtggcgcttctgaatctaccggaggtgcatctgaaccgactggagaacctactggaggtgcttcagaaagcaccggaggagcttccgagcctactggagagccaaccggaggtgctagtgagagtactgatggtgcttcggagcctactggtgaacctacaggaggagcttctgaatcaacgggaggtgcttcagagccaaccggtgagcctactggtaacggctccgagactactggtggatcttccactccaggatactcagtatca

SEQ ID NO: 2296 - DNA, 633 bp, Artificial Sequence
  Description of Artificial Sequence: Synthetic polynucleotide
ggtgataatggaactggatcaggtaacaccggtgataatggtacgggctccggcaacacaggagataatggtaccggatccggcaacaccggcgataacggaactggttcgggaaacaccggagacaacggtacaggtgctggcgacaatggtacaggtgctggagataacggcactggttctggtaacactggagataatggcactggatctggtaataccggtgacaatggcactggttctggcaacacaggtgataacggcacgggatccggaaataccggtgacaacggaaccggtgctggtgataacggtactggagctggagacaatggtaccggaagtggtaacacaggagacaacggtaccggatccggcaatacaggtgacaacggtactggttctggaaataccggcgacaatggtaccggtgctggtgacaatggcaccggagccggtgataacggaactggatctggaaatacaggcgacaacggaactggtagtggaaacacaggtgataatggaacaggtgcaggagacaacggaacaggatctggtaatacgggtgacaacggaactggcgctggcgataacggtacaggttccggtaacactggtgataacggaaca

SEQ ID NO: 2297 - DNA, 693 bp, Artificial Sequence
  Description of Artificial Sequence: Synthetic polynucleotide
ggtgcccaaggtccacagggtgttcagggtgtccaaggtgatcaaggtcctcaaggtgttcaaggtgctcaaggcgaccaaggaccacaaggcgttcaaggagttcaaggagatcaaggacctcagggcgtgcagggagtacaaggtgaccaaggcccccagggtgttcaaggtgttcagggtgatcagggacctcaaggcgtgcagggtgttcagggagatcaaggtccacagggcgttcaaggagcccaaggtgaccagggtcctcaaggtgtgcaaggagtgcaaggtgatcagggcccccaaggagtccagggagttcagggtgaccagggtccacaaggagcgcaaggtgtgcaaggtgatcaaggaccgcaaggagtacagggtccgcagggtgatcagggtccacaaggtgtccagggtgttcaaggagatcagggaccacaaggtgttcaaggagtgcaaggtgctcaaggtcctctgggtcctcaaggtatccaaggtccgttgggagcacagggcccattgggtcctcaaggtgctgagggtccattgggtgcccaaggccctcttggccctcaaggtgcagagggtccactaggagctcaaggcccattgggtccccagggtgcagaaggtccccttggtgcacaaggtcctcttggtccacagggtgctgaaggtccatta

SEQ ID NO: 2298 - DNA, 1002 bp, Artificial Sequence
  Description of Artificial Sequence: Synthetic polynucleotide
ggtataggaggaatcccaggcgctgtacctggtactggactgggaggcgttcctggactcacccctggtggaggcgccgtacctggtgttgtgccaggtcttgtgcctggagctggtggtgttcctggtgcaggtataccacaacttggagtacaaccaggtgccaaagcctctaaatacggattgcctggagttggaggtgtgccaggtgtcggaggtgttccaggtgtaggaggtgtgcctggcgttggtggagttccaggcgttggtggcgtcccaggtgttggtggtgtcccaggcgttggaggtgttccaggaccaactatttctggactaggtgcaaaaccaccaaagataggtggagtcggtgccggaggttttccagctggagtgggcgtcggaggtgtcccaggtgccggtgcttaccctgctggaggtaaacctccaaaaccaggatatggagctggagctggactgattccaggaggtggtattactcctggagctggcttgggtgctggtcttgttcctggagctggaacaggagctggactctaccctggaggtaagcctcctaaacctggatatggcttgccaggcggtgcacttacaccaggagcaggactgcaaccaggcgccggtttgcagccaggtgctggactgcagccaggagcaggattgcaacctggagccggcttgcaacctggtgcaggcctccaacctggagcagcaactggtgccggtacatacccaggaggtaaaccacctaagcctggtcttggtattggcggacttacacctggtgttgctggtctaggaccgggtgccggactggtgccaggagcgggaggtttagctccaggtgccgccggaggtgcataccctggaggaaaacctccaaagccgggcgccggcttagttcctggtgccggaggcctcgctccaggagctggaggtttggctccaggcgccggtggccttgttccaggtgccggcggatta

SEQ ID NO: 2299 - DNA, 876 bp, Artificial Sequence
  Description of Artificial Sequence: Synthetic polynucleotide
ggtggaatcgcaacgggcgttgctccaggtggagccggtggtctgtacccaggtgcaggaggaaagccaccaaaacctggatacggtccaggagctggttttgtgccaggtgcaggaattggtgccggcgccggagctggattacaacctggtggaatcggagcaggagttgctccgggtggtgtcggagctggtggactctatccaggagccggtggaaaaccacctaagcccggttatggacctggtgctggttgggtccctggtgccggagttggcttgggtactggagtccagccaggaggtactggtacaggcgttgccccaggaggaatcggcgctggcggactttatcctggtgcgggaggtaaacctcctaaaccaggatacggacttggcgccggattagtgccaggagctggtgtgggtcctggagctggtctgcagcctggaggcatcggtgccggtggtgtcggagccggtggattgtacccaggtggtaaaccacctaagccaggatacggacctggtgcaggttacgttccgggtgcaggttatgtaccaggtgcaggagtcggtcctggagccggtctacaaccaggaggcattggtgctggtgttgcccctggtggtgttggcgctggaggtttgtacccaggaggtaaaccacctaaaccaggttacggacctagagccggactgggtacaggcgctggtatcggcgctggactccagccaggcggaattggagccggagtggctccaggaggtgttggtgctggaggactatatccgggtggtaaaccacccaagcctggatatggtccaggtgccggttttgtcccaggtgttagcaatggagctggacagcaacca

SEQ ID NO: 2300 - DNA, 756 bp, Artificial Sequence
  Description of Artificial Sequence: Synthetic polynucleotide
ggtggtccaggtggagcaggaggccctggtgttgatgcacacggtcgacctactggtggctctggtacaggaggacctctggtagatgcatacggacgacctatctcaggtggtcatggtggtagacccgccggtggctcaggaacttcgggtggaccaggtgtcgacgctcatggtcgtcctattggtggtagtggaaccggaggtatcgacggtcaaggtcgtccatccggaggtaccgctgtggacgcctacggaaggccgattggtggtccaggaaccggatcaccaggtagcggtggtgcaggtaccggagttcctggtgtagatggtagaggcagaccttctggaggtccaggagtggatgcccatggtcgaccaattggaggtacgggagcaggcggtcctggtacaacaggtactggcaccggtggtggagttgatgcttatggacgtcctatcggaggtcaaggtactaatggtcacgacgcaaggggacctccagtcgattcacatggacgtcctattggaggtcctggaactggaggattaggttccccaattggaaccggtatcggcggtgttgacgcctacggtcgtccttctggacctggcggacaaggatctggtaccccaggaggtgcacctggtcactcgggactaggtacaggaggtcacggtgtagatgctcacggacgacctattggaggaccgggtacgggcgtctcaggtgttgatgctcatggacgtcccata

SEQ ID NO: 2301 - DNA, 729 bp, Artificial Sequence
  Description of Artificial Sequence: Synthetic polynucleotide
ggtgtcggccagtatccttctggtacaggtgccggtcaatacccttcaggtactggtgcaggacaatacccttcaggaaccggaggaacatctggtactggtcagtatcctggtggtactggtgccggacaatatccaggtggcattggcggaaccggtggcgtgggtcaatacccaggtagtaccggaacaggtcagtatccaggaggaactggcggtacaggtggtgctggtcagtatcctagcggcacaggtgctggacagtatccatctggtactggtggtaccggtggtgcaggacagtatcctggttcaaccggtgttggacagatacctggaggaacaggtcattatccatccggcacgggtgctggtcagtacccttccggaacaggaggtaccggaggtgctggacaataccctggatctacgggtgctggtcaacatcctggaggccttggtggtacaggtggtacgggacaatatccatctggtaccggtgcaggccagtacccatccggtactggaggtactggtggagcaggtcaatatcctggttctggacaatacccatcaggtactggaggtaccggttctgctggtcaatatcctagtggaactggcggagcaggacaatatcctaccggaacgggtggagccggaggagtaggacagtacccttctggcaccggcgctggtcaatatccaagtggcactggcggaattgga

SEQ ID NO: 2302 - DNA, 663 bp, Artificial Sequence
  Description of Artificial Sequence: Synthetic polynucleotide
ggtattggtggccagacaggtgcaggtcaaccaggttatggtagccaacctggaattggtggtcagacaggcgctggtcaacctggatatggatctcaacctgttgttggtgctcaaacaggcacaggacagcctggttatggagctcaaccaggtgtcggtacacaaactggtgctggtcaaccaggctatggttcacaaccaggtatcggaggtcaaacaggtgctagacaaccaggttatgtcacccaacctggagtcggtgctcaaactggaatcggacaaccaggttacggagctcaacctggtattttaggacagactggtgctggacaaccaggatatggttctcagccaggtattggcggacagacaggtgctggacagcctggttacggcacccagccaggagtgggtgctcaaactggcaccggtcaacccggttatggcgcccagccgggtgtgggtacgcagacaggcgcgggtcaaccaggatacggaagtcagcctggtattggaggacaaaccggagccggacaacccggctatggaacacagccaggtgtgggagctcaaactggtgcaggccaaccaggctatggagcacagcctggtgttggtgcgcagactggtgctggccagccaggttacggttcgcagcca

SEQ ID NO: 2303 - DNA, 768 bp, Artificial Sequence
  Description of Artificial Sequence: Synthetic polynucleotide
ggtatcggtggacaaactggaggtggacaacctggatatggttctcagattggcggtcagactggtgccggtcaaccatcatatggttcacagccaggagtgggcgctcaaaatggagctggtcaacctggatacggaactcaacctgtgattggtggacaaacaggcgctggacaaccaggatatggcggccagacaggagtgggtggaagccctggttttttgacccaaccaggcattggtggcatttctggacctatcggtggaaagttaggcggtggtcaaagcgaggcagcaaagccaggatattgggcacagccaggaattggtggaccatccaggtacggatctcaaccaggtatcggtgatcagactggtaccggtcaatccggatacggtggtcaaccaggaatatctggacaaacaggaggtggacaaccgggttatggaggccaagctactatctccggtctgcctggatacggtacacagccaggtatcggtgccttgaccgcagttcctggtggtcattatggttacgagactcaacctggtattggtggccagactggaacaaaccagcctggttttggtggtcagcctggaataggtggacaaaccggagcgggacaacctggttatggtttcatcggtcaaccgggtattggaggacaaaccggaacctccggtcgccagccaggttacggtacacagcctggtatcggtggtcagactgcagccggtcaaccaggatacggctctcaaaca

SEQ ID NO: 2304 - DNA, 756 bp, Artificial Sequence
  Description of Artificial Sequence: Synthetic polynucleotide
ggtgctgatggtgctgatggtgtggatggagttgatggattaggttggactggtggttcctatgaccctcttaccggcgtcgttactttcacgtctgatgacggcttgggttttgttacaggtgacttaaggggagctgatggtgccgatggtgtagatggtgttgatggtgccgttggacctcagggtccagagggtccacaaggattgcaaggagacactggtccacaaggacctcaaggcctccaaggtgagcaaggacttcaaggacctcagggtctacctggtgccgacggagccgacggagcccaaggaccgcaaggaatccaaggagagcaaggtttacagggtcctcagggtttacctggtgccgatggagctgattctaccgtccctggtcctcaaggccctaagggagacaaaggtgatactggtgacgctggtccacagggacctaaaggcgatactggcgacgctggtccacaaggtttgaagggtgatcctggaaatgatggagctgacggcgctactggacctgaaggacctcaaggtccacaaggaaacccaggcgctgatggcgctgacggagcccagggacctaaaggtgacaagggcgacacaggagatccgggagcacaaggtcctcaaggcaatccaggtgaccagggaccacaaggaaatccaggagcagacggagcggatggagctattggccctgagggtcctcagggtccacaaggaccagagggaccagaa

SEQ ID NO: 2305 - DNA, 933 bp, Artificial Sequence
  Description of Artificial Sequence: Synthetic polynucleotide
ggtccatacggctcctccttgggatactccgccttttatggttctagagtcggtccctttggcacttacggtacgagcggtctgtttggctctggatacggtccgtttggccatttaggaccttacggtagtgctttgggatactctggtctatatggatcaagactgggtccatttggaacctacggtacaagcgctctatacggatctggatatggaccttttggtcatttaggaccatacggcagtaccttgggatactcaggactctacggtagtagattgggaccatttggtacgtatggcacgtccggtgtattcggttcaggttatggtcctttcggacacttaggaccttatagctcaacacttggatattctggtttgtacggatcaagactgggaccattcggtacctacggtacttccgcattgtatggatccggttatggaccattcggacacctaggaccttacggatcaactttgggctatagtggcttgtattcctctcgtttgggcccatttggaacttacggaacaccgggtcttttcggttctggatatggtccatttggtcatttaggtccatatggatctacgttgggttactccggcctatacggtagcggtctaggcccatttggaacatacggcacatccttattcggttctggatacggtcccttcggacaccttggaccatacggtagttccctgggctattcaggactttatggctcaagtttaggtccttttggtccttacggaaccagtggtctttttggatctgtctacggcccttttggtcatttgggtccctatggatcgactctaggatattccggattgtacggttcccgcttaggtcctttcggaacttatggtacttcaagtttatatggttccggatacggcccttttggccctcta

SEQ ID NO: 2306 - DNA, 654 bp, Artificial Sequence
  Description of Artificial Sequence: Synthetic polynucleotide
ggtccatccagtggcgcaagtggacactctggaccatcctccggtgcctcaggccatagtggaccatcctcaggtgcatctggtcacagtggcccaagtagcggtgcttcaggacattctggacctagttctggagcatctggacatagcgttacgtcgtcgcataccggaccttcgagtggtgcctcaggtcactccggtccctcttcaggagcctcgggtcactcaggcccatcttctggtgcttccggacacagtggaccctcatctggtgcatctggccactcagtgacgtcaagtcatacgggtccttctagtggtgcaagtggacatagtggaccatctagcggtgcctcaggacactctggaccttcttcgggagcttccggacattctggcccatcatctggagcgtcaggtcattctggtccttcatcaggagcctccggtcattcgggaccatcctcgggtgcctccggtcattctgtaacctcttctcacacaggtccatcttctggtgcatctggtcattccggaccatcgagcggtgcttctggtcattcaggtccatcgtcaggagctagcggccactctggtccaagcagcggagcttccggtcacagcggcccatcatccggtgcttctggacactca

SEQ ID NO: 2307 - DNA, 825 bp, Artificial Sequence
  Description of Artificial Sequence: Synthetic polynucleotide
ggtataggtggaggccaacctggaattggtgttcaacctggatatggaggacaaactggtggccaaccaggatatagaggacaaactggaacaggaacaggtcaacctggttatggtggtcaaaccggaataggtggaggtgcaacccaaccttcgtacgctcaaactggtggacaacctggttacggtggaggtcagcaggtccaaccaggatatggtggacaaacaggagccggtcagcctggatatggaggtcaaatcggaacaggtcagcctggatacggcggtcaaactggtataggaggtggtcaaccgagtactggtattcagcctggctacggagcccagcccggctacggaggccagaccggaactggaactggccaaccaggttatggaggtcctgcgggcactggtcctggtctaccaggctatggtggacaaactggtactggtgcaggtcaaccaggatttggtggtcagactggagccggtcaacctggttttggaggacagaccggaactggtgtgggccagccaggttacggcggccaagctggaacaggacaaccaggttacggaggtcaaactggaggtcagcctggttatggaggtcagactggcactggcacaggacaaccaggatacggtggccagactggaattggtggtggacagcctggttacggtggtcagacaggaacaggaaccggcaagcctggttatggtgagcagaccggtacaggagcagctcagcctagctacggacaaacagctggccagcctggctatggcggtggccttccaggacaacttgtccaacca

SEQ ID NO: 2308 - DNA, 477 bp, Artificial Sequence
  Description of Artificial Sequence: Synthetic polynucleotide
ggttacactccatctggtaagagttctgagtccagcatgaacacagcttcgtctgagagttcgatgaatacggcgagctcagagagttggataaagactgcctcctccgaatcttctatgaacactgcctcttccgaatcgtctatgaatacagcttcttcagaaagttggatcaatactgcttcatccgaatcttcaatgaacactgctagctctgaatcctggataaacactgccagtagtgagtctagtatgaattcggcgtcgtcagagagttggatcaatacagcttctagtgaatcctggatgaacactgcttcatcagagtcttggattaacactgctagttcagaatcgtccatgaacaccgcgtcatctgagtcctggataaatacagcttcaagtgagagtagtatgtccaccgcttcttccgaatcttggattaatacggcatccagtgagtccagcatgtctaca

SEQ ID NO: 2309 - DNA, 846 bp, Artificial Sequence
  Description of Artificial Sequence: Synthetic polynucleotide
ggtacaacaacgtacagagtttcaggtagttcctcggcttcctccgacgtcccaccagtatatactacaacagtcacatcaggaagctcaaccgagactgacgttgtgagtgaatatagtacaaccgactctaatggaatgcctagtacgggtactactacataccacgttagtggatcttcatccgcgagtagcgacgtacctcctgtatacaccacgaccgtgacatcgggttcctctactgagactgatgtcgtatctgaatactccacgacagacagcaacggtatgccatctaccggtacaacaacttatcacgtgagtggttcatcctctgcttcatctgacgtacctccagtctacactaccactgtaactagtggttctagtactgaaacggacgttgtttctgaatactctacaactgattcgaatggtatgccttccacaggtactacgacatatgaagtaactgacagttgccctgattgttctactggagctccgtcgcatagaagtaatgaggtcagctccatgccgtctagttttgctacctcatccatgagttctatttcccctgccacttccagtggtatgcctccagtctatactaccacagtcacatcgggatcatctactgaaactgatgtggtttctgaatacagtacgactgactccaatggaatgccgtctaccggtaccacaacgtatcacgtttctggctcaagttcagcctccagcgacgtcccaccggtctacacaactaccgtaacgtcaggttcttcaacagaaactgacgttgtatctgagtacagcactactgactcgaacggtatgccttcgaca

SEQ ID NO: 2310 - DNA, 660 bp, Artificial Sequence
  Description of Artificial Sequence: Synthetic polynucleotide
ggtacgtacccaccaggacaggccccccctggcacttatgctccaggacaaggtccacctggaacttaccctccaggacaaggaccacccggcacctatgcgccaggacaaggacctcctggaacttatccacctggccaaggtccaccaggaacgtatgctcctggacaaggtccaccgggcacctatccacctggacaaggacctccaggtacctatcctccaggacagggtcctgctggaacttacccaccaggtcagggtcctccgggcacttacccgccaggtcaagctccacctggaacctacccccctggacaaggtcctccgggtacttatttgcctggccaaggaccaccaggtacatatccacctggtcagggaccgccaggcacttatcagccaggagagggtgctcctggaacctatcagccgggtccaggtgcaccaggtacatacgcacctggtcagggtcctccaggaacttaccctcctgaacagggccctccaggtacttaccctcctggacagggtccggcaggtacttaccccccaggtcagggtccaccgggtacttatccacctggacaggcacctccgggtacctatcctcctggacaaggaccacctggtacttacttgcctggtcaaggtccacca

SEQ ID NO: 2311 - DNA, 813 bp, Artificial Sequence
  Description of Artificial Sequence: Synthetic polynucleotide
ggtctgttgggtggataccctggattaggaggtttgtctagtttatacggaggatacccaggtctgttgggtggactgagcggtttaggtggacctcttggcttaggcagatatcctggattgtcaggactatatggaagatacggaactctgggttccttgagttcactgtatggtggctatcctggttacggtggactttccggtctattgggttcttatgctggtcttggaggcctatctaccctttatggtggttatccgggactgctaggtggtttgtcaggagtcggaggaccattcggtcttggccgttaccctggtctaagcggtctttacggacgatacggtactctgggatctctaagcacactttacggaggatatccaggatacggcggtttgtctggtttgctaggtggttatcctggattaggtggtttaagcggactgtacggcggttaccctggcgtcttaggaggtttaagcggtttaggaggtagattgggtcttttgggacgttaccctggactaagcggcctctatggtggttacggaactttgggaagcttatctactttgtacggtggatatccaggcttaaccggcgtatcctcgttgtacggtggttacagcggtgccctgggtggattgtctggattgggtggtccactaggagtcttaggccattacccaggattgtactcgtcaggtctgggcagccttggattattaggtccttacggttcatctcttggttactcagccctatacggatccagagtaggacctttcggtccatatggcacttca

SEQ ID NO: 2312 - DNA, 819 bp, Artificial Sequence
  Description of Artificial Sequence: Synthetic polynucleotide
ggtttgtttggatcagtctatggacccattggacacttaggaccgtacggatctactcttggatactccggattgtatggatcgtctctaggaccatttggaacatactccacgtccggcctgttcggatcaggttacggtccttttggtcatttaggtccttatggatctaccttaggttattcaggtttatatggttctaggttgggaccgtttggaacatacggcacatcatctctttatggaagtggatatggtccattcggtcaccttggaccctatggttcaactctgggttactcaggcttgtatggaagcagattgggacctttcggcacttatggtacttctggtctttttggaagtggttacggaccatttggccacttgggtccatacggatccactttgggttattcaggagtgtacggttcgagattaggtccttttggaacttatggaacaagcggtttatttggaagtagttacggacctttcggtcatctcggcccatatggctctacgttgggatattcgggcctgtacggatcatctctgggaccgtttggtacatatagcacctctggcttatttggctccggatacggaccatttggtcatttgggaccttatggaagcacactaggatactctggtctatacggttctagactgggaccattcggtacatacggtacatcttcattgtacggttcgggatatggccctttcggacctctgggtccttacggttctaccttgggctattcaggtctatacggatccagtgttggaccattcggaacttacggaacttca

SEQ ID NO: 2313 - DNA, 672 bp, Artificial Sequence
  Description of Artificial Sequence: Synthetic polynucleotide
ggtcagggttctccaggatctggtcagcctggttctggacacccgggcagtggtcaaccgggtagtggctcacctggtagtggacaaccaggatcaggatcccctggttccggacaaccgggtagcggttctcctggaagtggtcaaccaggttcaggcagtccaggttctggtcaacctggttattaccaaccaggatcacaaggccaacctggtaacggtcagcctggatcaggacagcccggctctggacaacctgagagtggacaacctggtaatggccaacctggttcaggccagcctggatcaggtgaacctggatctggtcaacctggatattatcgacctggtggtaagggacaaccaggaaacggacaaccaggatccggtcagcctggtagtggagaaccaggatcgggccaacctggttccggtcaaccaggctattacaggccgggaggtaagggtcagcctggtaatggtcaaccgggttctagtcaaccgggtagcggagaaccaggttcgggacaaccaggatctggtcaaccaggctactatcgtccaggtggcaagggtcaaccaggcaacggacagcctggatctggacaacctggtagcggagaacctggtagctcacagccaggttctggacagcctggatactatagacca

SEQ ID NO: 2314 - DNA, 720 bp, Artificial Sequence
  Description of Artificial Sequence: Synthetic polynucleotide
ggtcaaggtatgaggccaggtcagggcatgggaccatcccaaggtatgggtcctggtcaaggtatgggacctggtcaaggaattggtcctggtcagggaatgggccctggtcaaggagtgggcccaggtcaaggcattggtccaggtcaaagtgtaagacctggccaaggcatgggtcctggacaaggtatgggtccaggccagggcgtaggtccgggtcaagagatgggacctggacaaggaattggtccaggacagggaatgcgccctggtcaaggtgtgggccccggacaaggtatgggccatggacaaggtatggaacctggtcaaggaatgggcccgggtcaaggcctaggtccaggacagggtgttggaccgggtcaaggaataggttccgagcaaggtatgggccctggccaaagcatgggtccaggacaaggaatgggtcctagacaaggaatgggcccaggtaaaggtttcggttctggacaaggtattggtccaggtcagtcaatgggtcccggacagggaatgggaccaggccaagatgttggacccggacagggaatcggttcaggacaaggcataggtccaggtcaaggaatcggtcgtggtcaagttcttggtcctggacaagttattgagccgggacagggtctaggacctggacagggtattggaccaagccagggtatgtcccctggccaactgatgggtcca

SEQ ID NO: 2315 - DNA, 612 bp, Artificial Sequence
  Description of Artificial Sequence: Synthetic polynucleotide
ggtgaaggtgaagaaggtgaagataaggacaacaccggagagggagaggaaggtgaggacaaagacaatactggtgagggtgaagaaggcgaagataaggataatactggagagggtgaagagggagaagataaagacaacaccggtgaaggagaagagggcgaggacaaggacaacaccggagaaggtgaagaaggcgaggataaagataacacaggtgaaggagaagaaggcgaggacaaagacaacactggtgaaggtgaagagggtgaagataaggataatacaggagagggtgaggagggtgaggataaggataacaccggtgagggtgaagaaggtgaggataaggacaacacaggtgaaggagaagagggtgaggacaaagataatacgggagaaggagaggagggagaagataaagataataccggtgaaggagaggaaggcgaggacaaggataacaccggcgagggagaagaaggtgaggacaaggataatacaggcgaaggcgaagaaggagaagataaggacaataccggtgagggtgaggagggtgaagataaagataacactggcgaaggagaagagggagaggacaaggataacaca

SEQ ID NO: 2316 - DNA, 567 bp, Artificial Sequence
  Description of Artificial Sequence: Synthetic polynucleotide
ggtgaaggtgaagaaggtgaggaaggtgaagataaggacaacacgggagagggagaagaaggcgaggagggcgaggataaggataacactggcgaaggtgaggagggtgaagagggagaggacaaggataacacaggcgaaggagaagagggagaggataaagataacactggcgagggtgaggagggtgaggacaaagataacactggtgaaggcgacgaaggtgaagataaagacaataccggagaaggagaagagggtgaagagggtgaagataaggacaataccggcgaaggagaagaaggagaagataaagacaacacaggcgaaggcgaggaaggtgaagaaggtgaagataaagataatactggagagggcgaggagggagaggagggcgaagataaggataacactggagaaggcgaggagggcgaagaaggtgaggacaaagacaatactggagaaggagaggagggagaagataaggacaacactggagaaggagaggaaggagaggataaagacaatactggcgagggcgaagagggagaggataaggataataca

SEQ ID NO: 2317 - DNA, 363 bp, Artificial Sequence
  Description of Artificial Sequence: Synthetic polynucleotide
ggtcaacaaaaaaattctgagcagcaaaaaaacaacgaacaacagaagaactcagagcagcaaaagaacaatgaacagcagaagaattcggagcaacaaaagaactccgagcaacagaagaataatgagcaacagaagaataacgaacagcaaaagaacaacgagcagcagaagaataacgagcaacagaagaacaatgaacaacaaaagaataacgagcagcagaaaaacaatgagcaacaaaaaaataacgaacaacaaaagaactctgagcagcaaaagaataatgaacagcaaaagaacagcgaacagcaaaaaaataatgaacaacagaaaaataatgagcaacaaaagaacaatgaa

SEQ ID NO: 2318 - DNA, 1062 bp, Artificial Sequence
  Description of Artificial Sequence: Synthetic polynucleotide
ggtttgccaccaggtagtattcctccattgaggccaccaaatcaaggtggccatccacctggttcccagaagcctccgaacgtcggaatctacccgccatccactggttggatccctccttttggtcctcttacacaaggtggacacccacctggatctttattgcctcctaacacaggactaccaccaggttcgataccacctcttggaagcccgaaccagataggacatcctccaggctctcaaaaacccccaaatgttggtatctacccaccttcaactggatggactccaccatctggtcctttgacgcaaggaggacaccctccaggatctctgttgccacctaacactggattgccacctggatctatcccacctctgggctcccctaatcaaatcggacatcctccaggttcacaaaaaccaccgaacgtaggaatatatcccccatcaaccggttggattccaccttcaggtcctcttacccaatccggtcatccccctggtagtttgcttcctcctaatactggtttgccgccaggctctattcctccattacgtcctccaaatcagggaggacaccctcctggatctcagaagccgcctaacgtaggtatttacccgcctagcactggttggattcctccatccggacctcttacccaaggaggacatccaccaggtagccttttaccacctaataccggtttgccatcaggtagtataccaccattgggatccccaaatcaaattggtcatcctccaggctcgcaaaagccaccaaactcgggaatttatccaccaagtacgggtagtatccctccatcaggtcctcttactcagggtggacatccaccaggaagtctgttgccgcctaatactggccttccttctggcagtattccacctctcggttccccaaatcagattggtcacccgcctggatcacagaagcctccaaattccggtatctatccaccatctaccggttggattcctccttcgggaccattgactcagggcggacatcctcctggaagtctactaccgccaaacaca

SEQ ID NO: 2319 - DNA, 594 bp, Artificial Sequence
  Description of Artificial Sequence: Synthetic polynucleotide
ggtgcccagaagtggtgtgacaagacgtgtaaatgcaaatgcgagaaagaaatgccaactggtggatgtgagaataacaaaaaatggtgtgacgaaacttgtgattgcgtttgtcctcagaagaatacatgtattgctcctaaagtttgggacgccaaaacctgctcatgtatctgtgtaaatcctcctaagtgcaactcaccccaggttcttaaagacacatgttgctgtggttgtcaaaacgttaaaagttgcaaagctcctcaaaaattcatcgagaatatatgcgattgtgcctgtcccaataagaagcagtgcaaggcccctttagtttggtctgacgagttctgtgactgcgtctgcccaaactcggcgtccatgaaaacttgtttgtcgccaaaggaatggaacaaagtcacatgcacttgtgactgtaacccgccgaagccggactgttgtcctggtacacaaaagtggatggacgataagtgcaagtgcggttgccctaacgctcaaaccgattgtgctggaggtaagaaattcaacgactttacttgttcttgtggttgcccttctggtaagcttgactgcaca

SEQ ID NO: 2320 - DNA, 825 bp, Artificial Sequence
  Description of Artificial Sequence: Synthetic polynucleotide
ggtggaggcatgcaccatcagcatcaacagcatcaacaacaacaacaacatggaaagcatcatttgttattgcatcaccatcacacacacgatcaccaaaattctcataacaatggaaaccaccacgattcggaccatgaccacgttcaccatatgcaccatcatcttcagcaacatggtggtggagatgatgattcctcttctagcatgttggtgggttccttgttacaacaccatcaacatcaacaacaacagcatcaacagcagcaacatcaccatcaacaacaacaccatcatcagcaacagcatagtcctgttgatatctacgccgctgccgcagcagctgcacaccacaatcatcagcagcagcaacaacaccagcaacagcaacaacagcatcatagtcatcatcagcaacttcaattgcaacaacacttgaagtcatctgctgccgctgctgcagcagccgcagctgcagcagaatttgcagcttccaaccatcctttctcaataacgagacttcttccgccaccaccgactgcaagcgccgctgctgcagcctccgcttcagataagccttcgtctgccgcctctgtggctgctgccactgcttctagtgctacagctgcttcagctgctgaaaagatgtatgagatggctgccgcttcgcaatacggcactactgctggatataatgattattatcatcctcacgctcaccctcaccatcctcaccaccatggtcatccacatccacaccatcaacaagcatcactgtatcacgccgcagctgccgccgctgccgccgcggccgctgcagctgca

SEQ ID NO: 2321 - DNA, 609 bp, Artificial Sequence
  Description of Artificial Sequence: Synthetic polynucleotide
ggtactacaggaggaggaggtgttacttatcctggaggtgcacccggaacgactacgggcggtggtacttatcctggtggcgttcacggtacaactactggtggtggtggtacttacccaggaggtgttccaggcacaacaacaggtggaggtggcggtacctaccccggtggagtgcctggtacaactacaggaggcggtggaacttaccctggaggtgtccctggcactaccaccggcggtggtggtacctacccaggtggaggcggaacttatcctggaggagtccctggcactgtaacaaccggtggcggaggtacttatcccggtggcgtgcctggtacggtaacaactggaggaggtggaacttacccaggtggagtcccaggaaccaccggaggtggtggtacctatcctggaggcatgccaggtactacaactggtggaggtgttacctatcctggtggtacaccaggtaccaggattgatggtggcgcagtttatccaccaggtattcctggtactacgactggaggaggaggaacgtacccaggaggaatccctggaaccactaccggcggaggtgtgacttatcctggtggagttcca

SEQ ID NO: 2322 - DNA, 516 bp, Artificial Sequence
  Description of Artificial Sequence: Synthetic polynucleotide
ggtggtggtacttaccctggtggtgtcccgggaacaactactggtggaggagttatctatccgggtggtgttccaggtacaacgaccggaggtggcacttatcccggtggagtcccaggaactacgactggtggaggtgttatttacccaggcggcgttcctggcactactaccggaggaggaacttacccaggtggtgtccctggaactacaacaggaggaggagtcatctaccctggaggagttccaggtacaactaccggaggaggtacctaccctggtggagttcctggtacaaccatcaccggtgacgccagagtatacgttggtactattccttcaggtggtgtcgttggaggagaagtctatccaggaaaagttccgggatctggagttgtatatcctggtggagttccagaccgcaccacctccggaggagtcatttatcctggaggtgtgccgggcaccactactggaggtggaacctatcctggaggtgctccaggcactacgaca

SEQ ID NO: 2323 - DNA, 540 bp, Artificial Sequence
  Description of Artificial Sequence: Synthetic polynucleotide
ggtcaaaactcagagcagtctaacgaaggtcagaactccgaacagtctaatgaggttcaatcgtcagagcattctaacgaaggacaaaacagcaaacagtccaacgaaggtcagaattctgaacagtctaatgaagtgcagtcgtctgaacactcaaatgaaggacagaattccgagcaatcaaatgaggttcaatcctctgaacacagtaatgaaggtcaaaattctaaacagtccaacgagggacaaaattccaagcaaagcaatgaagtgcagtccagtgaacattggaatgaaggtcagaattccaagcaatctaacgaggatcagaactctgagcagtcaaatgaaggccagaactctaagcagtctaatgagggtcaaaactctaagcaatcgaatgaagatcaaaactccgaacagagtaacgagggccaaaactctaagcagtccaacgaagttcaaagctctgaacagtcaaatgaaggtcaaaacagcaaacaatctaatgagggccagagttctgagcaatctaatgaa

SEQ ID NO: 2324 - DNA, 720 bp, Artificial Sequence
  Description of Artificial Sequence: Synthetic polynucleotide
ggttatggaagcactcaaactgctcgtgaaggatcaaatttgacggctggatacggttccactggtacggcaggatctgactcatccctcattgcaggatacggatcaactcagacctctggagaggactcctcattaactgcgggctacggaagtacacagactgcacaagagggctcaaatctgacagcaggatatggtagcaccggcacggcaggttcagattcttctttaatcgcaggctacggttctactcaaacttctggtggagattcttccctaacagctggttacggaagcactcaaacagcgcaagagggaagtaacttaactgcaggttacggaagtactggtaccgcaggatctgatagctcactcattgctggatacggaagtacccaaacaagcggtgaggattcatctttaaccgccggatacggttcgacgcaaaccgctcaggagggttccaacttaacagcaggttatggttcaacaggaaccgcgggatctgactcgtcattaatcgccggttatggatccactcagacgtctggtggtgactcttctctcaccgcaggttacggctcgactcagactgcccaagaaggttctaatttaactagtggatatggttcgacaggtaccgccggtgccgactctagtttgattgctggatatggttccactcaaacgtccggttctgattctgctcttacagca

SEQ ID NO: 2325 - DNA, 612 bp, Artificial Sequence
  Description of Artificial Sequence: Synthetic polynucleotide
ggtagtggacgaatggctgactccggaggaatggccggtagtggcagaatggcagactccggtcgtatggccggttcaggacacatggcaggcagtggacatatggcaggcagtggccacatggcaggatcaggtagaatggctggatccggaagaatggccgactctggtggaatggctggttcttggagaatggccggttctggtagaatggccggatcaggaagaatggcaggaagcggtcgaatggctggttcctggcgtatggccggatccggtcgaatggcaggttccggaagaatggctggatctggtcatatggccggttctggtgatatggcaggttccggatgcatggccggttcgggaaggatggcaggttcaggtcatatggcaggctcaggaaggatggtcggatcgggacatatggttggatctggcagaatggcaggttccggtggcatggctggttcgggtagaatggctggttcatggcgtatggcaggttctggaagaatggctggaagcggacgcatggctggctccggtcacatggccggatcaggagatatggctggaagtggttgtatggctggatcgggaagaatggca

SEQ ID NO: 2326 - DNA, 648 bp, Artificial Sequence
  Description of Artificial Sequence: Synthetic polynucleotide
ggtgtcccaccatctgccggtgttccaccatccgcaggagtaccaccatctgcggacgtacctccttcagctggtgttagtccaagcgctggtatcccaccttcagccggagcacccccaagtgctggtgttctaccgtccgcgggagttccgccgagcgccggagcacctctgtctgctggtgtgctgccaagtgctggtgtgccaccttctgctggtgtccctccatccgcaggagcaccaccttccgccggtgtacctccttccgccggtgtttctccttccgctggaattccacctagcgcaggagccccaccttcggctggagttctaccttcggcaggagttcctttatcagctggtgttccaccaagcgctggtattccaccttcagctggagccccaccatccgctggtgtgcctcctagcgctggagctccaccttccgctggtgttccgccgtcagcaggagtgcctccatcggcatctgtaccaccgtcagcggatgtacctccctctgcaggagtgtccccatccgcaggaataccaccatcagctggaatccctccctctgccggaattccccctagtgctggagctccaccgagtgccggtgcacctccttctgccggcgttccgccatcggca

SEQ ID NO: 2327 - DNA, 885 bp, Artificial Sequence
  Description of Artificial Sequence: Synthetic polynucleotide
ggtgaggtctataactctgccaagaaaacatgctcatgcccagatggtcagtattggaacggtaaacaatgtgtttgtccatatggtcaagttttcaatggaaagcaatgtgttcctgattgtggcaaagaggcaactttcgattacaatcaaaagaaatgcgtctgcaagaataagggtgagatttacgatagtaagacaaaaacttgctcttgtcctgatggacaagtctggaatggcaaacaatgcgtatgtccgtatggacaagttttcaacggtaagcaatgtgtcccggattgtggcaaagacgccacatatgattataatcagaaaaagtgtgtctgcaaaaacaaaggagaagttttcgaccaaaaaactaagacttgctcctgtccagacggtcagtattggaatggtaagcagtgcgcatgtccgtacggacaaatttttaacggaaaacaatgcgttccagactgtggtaaagacgccacctatgattacaaccaaaaaaaatgcgtatgtaagaacaagggtgaggttttcgaccaaaagactaaaacttgtagttgccctgacggacaatattggaacggaaaacaatgtgtttgcccatatggcaaaattttcgacggtaaacagtgtgttgaagattgcggtaaagacgcacactttgacaacaaccaaaagaagtgcgtctgcaataaaaacggtgaaatatacgattcaaaatctaagacctgttcctgcccagattcccaatactgggacggttccaagtgcgcctgcccttatggtactgtctgggatggtaagcattgtaaccaggattgcggaaaggatgctcatttcgattccaaccagaagaagtgtgtttgcaacaaacaa

SEQ ID NO: 2328 - DNA, 720 bp, Artificial Sequence
  Description of Artificial Sequence: Synthetic polynucleotide
ggtttatggctatgtaaagcaaatactagattgagacgtcagaacggtcattgtcctccaggattgtggctgtgtaaggcaaatactcgactccgcagacagaacggacattgcccgcctggattatggctgtgtaaagctaatactaggcttagacgtcaaaatggtcattgtccaccaggcttgtggttatgcaaggctaacactcgtttgaggcgtcaaaacggacattgtccaccgggattgtggctttgcaaggctaatacaagacttagacgacaaaatggacattgcccacctggattgtggctgtgcaaggctaacaccaggctaagacgacaaaacggacactgtccaccaggtctttggctttgtaaggccaataccagattgagacgccaaaacggccactgtcctcctggcctctggttgtgcaaggccaatactcgtttaagaaggcaaaatggtcactgccctccaggtctgtggctgtgcaaagctaacactagactgcgtcgtcaaaacggtcattgtccacctggtttatggttatgtaaggccaacacaagattgagaaggcagaatggtcactgtccacctggcttgtggctatgtaaggctaatactagactaagacgtcaaaacggtcactgtcctccaggcctttggttatgtaaggctaacactaggttaaggcgacagaatggtcattgtcctcca

SEQ ID NO: 2329 - DNA, 630 bp, Artificial Sequence
  Description of Artificial Sequence: Synthetic polynucleotide
ggtccatggagatcggttggtggtagtttgggcccatggaggtctgttgaaggatccctaggaccatggagatctgttggaggatcgctgtccccatggagatcagctgaaggttcattgggaccttggcgatctgttggtggttcattgggtccgtggcgatcggttggcggaagccttggcccgtggcgatctgttgaaggttcactcggaccatggcgaagcgttggtggaagccttagtccatggagatctgccgagggttccttaggaccatggcgatccgtcggtggttcccttggaccatggagatcagtaggaggaagtttgggtccatggcgttctgtcggaggctcattgggaccatggagatcggcagagggttcgctcggtccatggagatcagttggaggtagtctgggcccatggagatccgtaggaggatccttgggtccttggaggtctgtgggaggtagcctaggtccctggagatctgtagagggatccttaggaccttggcgttcggtcggtggatccttgggaccttggaggagcgttggtggatctctcggaccatggaggtctgctgagggatccctcggaccttggcgtagtgtcggtggttctcta

SEQ ID NO: 2330 - DNA, 576 bp, Artificial Sequence
  Description of Artificial Sequence: Synthetic polynucleotide
ggtgaagaaagcgataacggagaagagtccgacaacgaggaggcttccgacaacggagaagcttcagataacggtgaagagtcagataatgaggaggcttcggacaacggtgaagagagtgacaacggtgaagagcgtggcaatggcgaagcttctgataatggagacgaatccgataatggagaggcgtctgacaatggagaagagtcagataacgaagaagcctctgataacggagaggaaagtgataacggtgaggaatctgataacggagaagaaagaggtaatggtgaagctagtgacaacggagatgaatccgataatggtgaagcttccgataatggtgaggaaagtgacaatgaagaggcctctgacaatggtgaagaatctgacaacggtgaagcatcagacaatggtgaggaatcagacaacgaagaggcttctgacaatggcgaagaatctgataatggtgaggcttcggataacggagaggagtctgacaacggcgaggaaagagataatggagaagcatcggataacggtgaagaatctgagaacggtgaagagattggtcta

SEQ ID NO: 2331 - DNA, 495 bp, Artificial Sequence
  Description of Artificial Sequence: Synthetic polynucleotide
ggtccattgagtgtggacccacaatctgtaggtcctctgtctgttggttcacaaagtgtaggaccacaaagtgttgatcctcagtccgttggtccgctaagtgtggatcctcaatctgttggtccattatctgtagaccctcagtctgtagatccacagtccgtcggaccactgtcggtcgaccctcaatctgtgggaccactatccgtagacccacagtctgtaggccctctttcagtcggacctcttagtgttgacccacagtcagtaggtccacagtcagttggtcctcaaagcgttggacctttaagtgtagatccgcagtctgttggaccgcaaagtgtcgatccacagtctgtaggtcccttgtctgtagacccgcagagcgtgggtccgttgtcagtgggtccactgagtgtggatcctcagtcagtcggccctcagtctgttggacctcaatccgttggaccattgtcggttgatccacaatctgta

SEQ ID NO: 2332 - DNA, 768 bp, Artificial Sequence
  Description of Artificial Sequence: Synthetic polynucleotide
ggtagccctcaggctcaagagggcgccccaggtaggtcgtcagctcagggttctacgcaggcccgtgaaggtgcaccaggaagatcgtccgcaagaggatcacctcaggctcaagaaggcgctcctggtcgaagctctgctcaaggttcaactcaggccagagagggagcaccaggtaggagttccgctagaggctcacctcaagctcaagagggtgcccctggtcgatcgagtgcccagggtagcactcaagccagagaaggagcaccaggtagaagctctgcacgaggatccccacaagcccaggagggtgcacctggtagatcttcagctcaaggaagcactcaagcaagagaaggcgccccaggtagatcatcggccaggggttccccacaggcacaggagggtgctcctggtcgttcttctgcacaaggatcaacccaggctagggaaggtgcacctggaaggagtagtgctcgtggtagtcctcaagctcaggaaggtgctccgggtagatcctccgcacagggttcgacccaagcacgtgaaggtgcacctggtcgttccagtgctaggggaagtccacaggcgcaagaaggagctcctggcagatctagtgcccaaggttctactcaagctagagagggtgcaccaggtcgttcttctgctaggggttcaccacaagctcaggagggagcaccaggcagatcatcggcccaaggatcaacacaggcacgagagggagctcctggaagatcttctgccaga

SEQ ID NO: 2333 - DNA, 606 bp, Artificial Sequence
  Description of Artificial Sequence: Synthetic polynucleotide
ggtggaggtggtccaggaacacaatttccgggtggcgttgtatatcaacctggtacccaagttggcggtggtggtcctggaacgcaaccttccggaggagttttatatccgccaggaacgcaggttggaggtggtggtcctggtacacagttcccagatggtgtagtttaccaacccggaacccaagttggaggcggcggtcctggtgcccaactgccaggagccgtcctctatcctccaggaacccaagttataggaggcggaggacccggaacacaaacaccaggtggtgttgtctaccaaccaggaatccaagctggcggtggaggccctggtgcacaagcccctggaattgtctaccagcctggtacgcaagtcggcggcggacctggcgctcctggcggtattgtttatcaaccaggaaccaaaactgtgggaggcggtcctggtgctcaagctccaggtgtcgtctatcaacctggaacacaggttggtggtggccctggtgcacctggtggaattgtttaccaaccaggaactcagactggtggaggtggaccaggcgctcaagccccaggtttgatttatcaacctggaactcaggca

SEQ ID NO: 2334 - DNA, 855 bp, Artificial Sequence
  Description of Artificial Sequence: Synthetic polynucleotide
ggtatgaacaggttcatgaacagatataggcctatgtttaacaatatgtattcgaacatgtacagaggtcgttatagaggaatgatggaacctatgtcgagaatgacaatggatttccaaggtcgctatatggattcacaaggacgtatggtggatccaagatattatgactattatggacgtttcaatgactatgacagatattatggaaggtcaatgtttaactacggatggatgatggacggagacagatacaatcgttacaacagatggatggattacccggaacgttacatggatatgtctggataccaaatggacatgtcgggtagatggatggatatgcaaggccgacattgcaacccttactctcagtggatgatgtataactacaaccgtcacggttattatccaaattattcctatggtagacacatgttctaccctgagaggtggatggatatgtcaaattacagcatggacatgtacggaagatatatggacaggtggggaagatattgtaaccctttcagtcagtacatgaactattacggtagatactggaattaccctggatacaacaactactactactcccgaaatatgtattacccagaaagatacttcgatatgtctaactggcaaatggacatgcaaggaaggtggatggacaaccaaggtagatactgtagtccatactggaataattggtatggtagacatatgtactatccttaccagaataactacttctatggccgatatgactaccctggaatggactacagtaactaccagatggatatgcagggccgatacatggaccaatacggaatgaacgattattattactca

SEQ ID NO: 2335 - DNA, 1401 bp, Artificial Sequence
  Description of Artificial Sequence: Synthetic polynucleotide
gaagacttaaggtttgcagccctccgccggatatcagcctggagcaggttatcagccgggaactggcttgcaaccgggagctggataccaacctggagctggacttcaaccgggtgcaggagtacaaccaggagctggagttcagccaggagccggacttccaccatcagctggattgcagcctggcgcaggtctacagccgggagccggcttacagcctggaacgggataccaaccaggtgctggttatcaacctggagccggcttgcagcctggagccggacttcagcctggagctggactccaacctggcgctggattacaacctggtgcaggataccaccctggagcaggtttgcaacctggtatcggaccacaaccaggagccggcttgcagtccggagcaggactacaaccaggtagcggtttgcaaccaggagctggttatcaaccaggacccggtctgcagccaggtgcaggatatcagccttctgctggtatccgtccagacatgggactccaaccaggtgctggatacaagccaggttcaggctatcaacctggaagttcgtaccaacctggtgctggattgcatccaggtattcagcagggaactggactacatccaggtacaggtttgcaacctagagtaggcttacagccaggcgctggtgtgcaacccggtgctgaataccagcctggttccggttatcaacctgatgctagtttgcatcctggtgctggtctacaacctggaggaagattgcaaccatctgccggtctacagcctggtactggattgcaaccaggagtcggagtacaaccaggtgcagaatatcagccaggatccggatatcaaccaggagctggcttgcagccaggagcaggtttattgcctggtggtagattacagccgggtgcaggacttcaacctggtacaggtttacagccaggtgctggatatcaaccaggttctatctaccaacctggtgcaggatatcaacctggtgccggactccaaccgggagctggtgtgcaaccaggaaccggttatagaccaggagcaggattacagcctggtggacgcttgcaaccatctgctggattgcagccaggtgccggacttcagccaggtgcgggtgttcagccaggcgctgaataccagccgggatctggataccaacctggtgcgggactacagccaggaactggaatccagcccggtgcaggtctgcaacctggtgtaggccttcaacctggtgccggtttacaaccaggagctgtcctccaacctggaacaggatatcagccaggagcaggctatcagccaggtactggattgcaggctggagctggattgcaacctggagctggtttgcaaccaggatcaggtacgtcttc

SEQ ID NO: 2336 - DNA, 1107 bp, Artificial Sequence
  Description of Artificial Sequence: Synthetic polynucleotide
gaagacttaaggttcacctttagaggagaagtacgacgagaagtccgaagctgatgactaccaatcagaagattcatctgctgccattcacgaccagacaaccaaaatcgccactaatgccgtgaaaacttacgctaataaggccaaggctaccgagtcaaaggctaagttgtatcatcaatactctaaggatcgtgcctattatagcagagaatacgagaagatgggagaagaatatatgaagaagtccaaggagtatgaacagctttatatagccgaggctgctaggatcagcttgcacgagaataaacaaaaagagtgggacacgaaaggtagagaggcaaatgttggaataagagagtacgaaactaagtcccaacaggcttcttcgaagaaaaatgagctattggaagagagcattatcgctgctgttcaggctgcaatccatgaaacgcaggcaacaggatatctgctaaaatcagaggctgcaaacggtattgctaggaacatgttgcaaattgcagagtctattagggacgaggcctctaatcactaccaaattggtaaagaagagttgaatagagcaaccgctcagaaggtaaaagctcaacaacaggccgaggattctcagcgccaccatgctgctgcgagagcttatcaacaggactctctaagatctagaatggcctccagagccaataatatgcagtatatgcagaattcattattggcagaaagagcacactcgctttctacggagaacactttggaatcagaattgtatggaaaggaggctgacgaattggctaaaatgtcggaagagtccgccgctatctcgaaaatttgttcaggagaggaaagatcctacagaaacatggctaagcagtcagaagtgaaagcttacgaatattccgtatcgaagaatatgatgggtgcagatatgaccgataccgctgcaatggctaatggcgacgaagctaagcaaggtgacgacgaggagcagcaaatgtataggtcacctaacatccctgccgaggatagtaccaagaacctttcctataacttaaaggattctactgagggtgaaggtatgtcaggtacgtcttc

SEQ ID NO: 2337 - DNA, 1074 bp, Artificial Sequence
  Description of Artificial Sequence: Synthetic polynucleotide
gaagacttaaggtaaaaaacatgaagccttaaccttcggttctggctacaagtcaacttacggcgaaggtgaaacattcgacgacgaggatgaccaagctttacgtaatgagagagtgccagtaggagctttatctgcagctatcataaacccttacgctctacacagtgaagaaggaagaatagcttacgatacgtcgagccaatactacgcaaataaggccgagggttcggcagacctttcccgcgaaaaaaagcagatgcatggtgaatatcatggtaaagctgccacatacgcgtccagggcgaacgaggcttataagaagtcccagttgcataagcgtcaagccaaagacaaacaggctattgccaaggagtatgaggagcgggctcagaaacatgaatcgaggtcaaaggctctcgatgtacgtgaccaagatgacgagcgtaaatcagtcactgaaatggaggaatacgctagagctctaaagatcgctaatcttgcccttgtctttgctggtatttaccaggagactggtcgattacaattggaggccaccaatgtttttgagcagtttcataaaatgctgtccacaaaaggcgaagagtataaaaaacaagcagaggaatacaaggaaaaggccaataaggagaaggaggaagctgccatccagcaagcaaaaagtaaagaattgaatgctaaagcacaagaatatgaaaatatttttatagagtcctctaagaagctggctgctaatcgttattacgagcttgaattcaaaatgaaagccgagaacgaaaggcatcacgctgaattggcacgtattagatctaggtttttgagtaggctagcaaactataatagagagcaagcagaagctgtcctcagatttgctcgatcagaaagaaaagacggagaaatttttaggcgcaatgcaatcgaactctataaagagactagagccctagctgctacagccgcaagagttatgaagcaacaccgttatacgggtcaagaaatatacacgaaacaaccttttcctcattctaactatcacggagcaggtacgtcttc

SEQ ID NO: 2338 - DNA, 1113 bp, Artificial Sequence
  Description of Artificial Sequence: Synthetic polynucleotide
gaagacttaaggttcacctctggaggaaaaatatggtgagaaatatggagatatggaggagtatcagagaggtacggaagattcaagagccgttattaacgaccatactgccaaggtggcctcccaatctgcacgaggaatggttaacaaggctaaaaccacagaagccgctgctagatctaacgagcaactttctaaagatcgtcagtactactaccgtgagtatttgaagaaagccgattaccataagaaaaaggctttggagtacgaacaattgtcagcagccgaaaacgccaaaatcgcctaccacgagagtaagcagaaagattgggagacaaaagccagagagtctgatgtccagtgtagagatgctgaagccaagtatgaacaaagttatactagatctcgtgaattgaagagagagtctattatagcgtatgttcaagcagctatgcatcatgccgaggcgtctggtgaccatatgaaagcggacagagctaaggacattgccagagatatgatgaggaaagccgagtccttaaggggtgatgctagtaaccattaccagagaagcgaggaggataagaacaaggcaaggtctgagaaggtcaaagctcaccaaaacgcagataattcccaacgccaccacactgcttgtagggcctatgaccaggagggattgaaaactcgtctttcctctaaggctaacatgatgagacaaatccattcatctttactcgcggaacgaagccactctttggctagagaggacggtctagccgctgatttgtcacacaaactagccgaagagcttgctagaatgtctgaggagtctggtgcgatttcaaaaattaattcgggagaagaaagaggttattccaataaggtgaggcaagatgaagttaaagcacacgaactcgctgttagcaagagaatgatgggtgcagaggtggccgataattctgagatgatttccctggcacaagcaaaagatggttccttggatgagggtgagaattataagctctctactttctatgcagacgatagcaccaaaaacatgttgcccgattcaaggggacaaatgagctatggtgatgaaggtacgtcttc

SEQ ID NO: 2339 - DNA, 1065 bp, Artificial Sequence
  Description of Artificial Sequence: Synthetic polynucleotide
gaagacttaaggtaagaaccatgaagtcatgacctatggctccggatataaaactatgggtgatgagggaggatcgggtgttggcaacgaaggtgaggactatcaagacaacgaaggagccactgcagctactattttggacgagtctacccatcataccgaagaggctcgcgacattttcggtacacgttcagaagcccatgcctacagtgcggagatgtttgctgacttagttagagaaaagagacaagctagtatcgaaagccacaagaaggcggaggactacgccgtcagagctaatgaagagtccaagaagagtcaacttttaaagagacaggcgagagataagcaagccatagctaagcagtatgaagagaaggctcagaagtacgacagaatcagtaagcaacaagacattaaagaacaggatgattacagaaagtccgacgccgagagtgaggagtataagcgttccattgctgtcgctaacgctgctctggctctagcgtccgcttacgaagaggcatctcgtatggagcttgacgccactggtgagatggaacaacaatccaaggagctttataccaaaagtgaagaatataataaggttgcggaagaatgcattacccgtgccaaaaaagaaaaagaactagcgagaatagaagaagcaaagggtaaagaagcagaggctaaaagtcaagaatacgaaaacttcgcgactgacaacaacaagaaatataacgcaatgaagttttatggttgggagttcaagatgaaagctgagaacgaaaggcacaacgctgattactgtagaattaaaagtagatacttggcccagttatccaattataacagagagcaggccgaggcgctttaccacttcgctgctgcccagagaaaggatgccgaattgtttcatcgatacgctatggagttgtataaacagaccagagtgcttactgctagcgctgcccaaattatgaagcaacatcgttacactggccaagaaatctactctaagcagcctttccctcattcgaactaccacggagcaggtacgtcttc

SEQ ID NO: 2340 - DNA, 1119 bp, Artificial Sequence
  Description of Artificial Sequence: Synthetic polynucleotide
gaagacttaaggttcgcctctagaggacaaatatgatcagaaatatgaagttgaagattacagaggtggtagcgaagataccaaagctgctatcaacgataatgcagccagagtcgcttcacattccgctaagtcacacgtcaataaggccttagtggtagaagctgctgctagactaaatgctcagattgccaaggaccgtaactactatgctagagagtacacaaagttggccgaagagtctaagaagagagccagacaatatggtcagctggccgacatggaggcaggtaggattggacaacacgaacatatgcagcaagaatggaattcgaaggcaagagagtccgaagctcaatgcaaagcgaccgaagccaaagctcaggaggaatacaccaaagccagagatgagcgtcagaaatcgttggtttctaacgctgaggctgccatgcatgatgctcaagccactgttgacactatgaagtccgaaagggcttatgagattggaaaagagttaatgcgcaaagctgagaacgctagaaacgatgcttccaaccactatcagcgagctaaggagaatagagaaagagctaatagtgaaaccgttaaatcacaccaacaagctcaagacgcccagagacacaacgccgcttccaaggcctaccagcaagatggcctccgaacaagaatggcctctagaattaacattatgaagtacattcagtccagcttgttggctgaaagggctgccaaccaagctagaatagagcaactcaagtctgaatggtacgagaaggcagctaacgagtactccaggatgtctgaagaaaatgccgctatttccaaacttgcaggttctgaggaacactacttcgctcaaagagcgaaaagaaacgagggcaaggcttatgaattgtctcagtcaaagagaatgatgggttccgaggctgccgctgccggagaactgctggctatgtcacaggccaaggatgacgagactgaagatgagaagcatttcgactttccaatttacgagtctgacgatccaactaaactgtcgccatctccggacgaaaaagatttgacatacggttctggtgagggcctaggtacgtcttc

SEQ ID NO: 2341 - DNA, 1047 bp, Artificial Sequence
  Description of Artificial Sequence: Synthetic polynucleotide
gaagacttaaggtaagaagcacgaagtcatgacttacggttcaggatataaacacatgggtggagaaacttatgaggacgttggaactggaaacagactaggctctactgctttcgacatcatggaagccgctgacgaaaacaccgagcgagcgtcccatactttcggttcaaaatctgccgcatactcgtccgacgctgacttatttattgagctcctccgggaaaagcgtgagacgagagcaaaccatggtaaacgtgctgaatcacaggcagttttagctaacgagtcgtaccagaagtcccaattgcataaaagacaggccaaagataaacaagccatttctaaagagtatgaggagagagctcaaaaacacgatagactttctaaggagcaggacatgaaggaacatgatgactatagaaagtctaatgcagaggacactgaattgaggaatagtgttgaacgttcaaactatgaccatgtgatggctttaggttatcacgaacttagtcaactcgaaatgggtgaaactaatcaatgtgaacaattgtccagagagctacaatccagagctgaagagtatttcaacctggccaaagaattgaaagagaaagccaagaaggaaaaggaaaatgcccgaattaaaaaggcaaaagccaaggaagaagaagccagagcagaagaatacgaaaatgcctttactgaaaatagcaagaaggtattagcatacaagttttatgagctggagttcggtatgaaggctctaaatgaacatcatcaggctgaatcagcacgtgtccgccatcactttttacagattttagagcaacacaatagtcaacatgcagacatgctttggggatacgcacaacaggaagataaagacggtagatcttttactcagtacgcgaccgagctctcaaagcagaccaaaatgctcaccgctaccgctgctcacctgatgaaacaacaccgctatacgggtatggagatgtattcgaagcaaccgttccctcactctaactaccatggaggtacgtcttc

SEQ ID NO: 2342 - DNA, 771 bp, Artificial Sequence
  Description of Artificial Sequence: Synthetic polynucleotide
gaagacttaaggtcctagaggttggtatggccctagaggattgggcccccgcggtctgggaccattaggattggattcagacatcattggagatggttacggtccgtatggtttgggatctcgtggattgggaccattgggacttgattctgacataatcggtgacggctacggaccaagaggattaggtccacacggattgggccctagaggtctaggtccactaggtttggattcagatataataggtgatggatacggaccttacggattgggtcctaggggtctgggtccattgggaggtttgggaaggcgaccttacggtggatactctgcatctggttctgtatctgccgaaggcccacgtggatggtatggcccacgaggcttgggtggaattggtggttggagatccagaccatatggaggttactcggctagccactctgtcagtgttgaggccccagttgtataccatgcacctatcataaggagagctcccaaaatttctagatcatcctcctactccgtggaaagaatagttacaccaactgttatcaccagaatctctggttctcattccgtatccgcagagggtagaagaggtgtttggggtccacatggagtctggggacctagtggcctttacggcgattcaggtatagtcgacggagtctacggacctggtttggttggccctggaggctggggaagaaggccatatggaggatactccgcttctagatctgtcagtgctgaaggtacgtcttc

SEQ ID NO: 2343 - DNA, 861 bp, Artificial Sequence
  Description of Artificial Sequence: Synthetic polynucleotide
gaagacttaaggtccaagaggctggtatggaccacgcggtctaggaccaagaggattgggacctttgggattagattctgacataattggtgatggatatggaccttacggactcggctcacgtggcctcggccccttaggtctggacagtgacataatcggtgatggatacggtccaagaggtctgggaccgagaggactaggaccacttggccttgactccgacataataggagacggttatggaccctacggcttgggtccacgcggattgggtccactcggaggtttgggaaggaggccctatggaggttacagcgcatctggtagtgtttctgcggagggaccacgcggatggtacggcccgagaggcttgggtggtattggcggatggcgttcgaggccatacggtggatactcagcctcccattcggtgtctgttgaggctcctgttgtctaccacgcaccaataattcgtagggctccaaaaatttctagatcagcttcttatagtgtcgaaagaattgttagacctaccgtaattactaagatccataagtctgtttcgcattctgtggaacaacctatttactatcgaccaccagttgttgttcgcgctccaaaagtcagcaagtctgaatcctattccgttgaacgtattgtaactccgacagtgattactcgaatacatcactccgcatctgattctgtagaacagcctatttattacagacctcctgttgttgttcgacgtccaaagatttctagatctgcttcttattcagtagaaagaatcgttaccccaacagtgattactaggattagcggctctcactcagtctccgctgaaggtacgtcttc

SEQ ID NO: 2344 - DNA, 405 bp, Artificial Sequence
  Description of Artificial Sequence: Synthetic polynucleotide
gaagacttaaggtaagattggccataacgcccagaaaggtatcgatgacttcttgggtggcgcccacatctcgaaatgtggcaaacatgagcgaattttacaaggagaggatattattgaaactaacgctaaaggagaactgatcgagaagattgtgtcacgtaaggagattcttacagacgatgatagcgaatccttctctgtttcctacagtagtgaggacgattctacagaaactatagttaagactattacaatcgtgcaagagattcctaagcatggaaaaggtaagggtcatgctaaggaaaaaattttcgaagaagaaacggttatcaaaaaaatcggaaagggtgtcgccgcacctgtagttgctcctgctgttgacatagttggaggtacgtcttc

SEQ ID NO: 2345 - DNA, 621 bp, Artificial Sequence
  Description of Artificial Sequence: Synthetic polynucleotide
gaagacttaaggtagacgcggtgtctatggtccacgtggcgtctggggaccatcgggtttatacggcgattctggaatcctcgatggcgtatatggtcctggtttagtaggaccaggaggatggggacgtagaccatacggtggttactccgcttcttcatctgtgtcggcggaaggcccaaggggatggtacggtcctagaggactgggtcctagacgtatcggcctgggaggctactcagcctctggttctgtaagcgctgagggaccaagaggatggtatggaccaaggggcctaggacctcgtagaataggttctttaggtggatactcagcgagtggttctgtttctgctgaaggtatcagaggcgtacttcgtccgtcccctggtattgtggtgcctggtgttatatcctccggtgtggttgctcctggcttagttggcggacatggaggattagtgaacgtcggtggaacccacgtcttgccaggtacatctgtctatactacacatccagatcctagaacggttagatcttcctgtagaacctccccctacaacctattgattaaagttggtaacgctagaaagctgaatggcaattgttcaggtacgtcttc

SEQ ID NO: 2346 - DNA, 792 bp, Artificial Sequence
  Description of Artificial Sequence: Synthetic polynucleotide
gaagacttaaggtaacagatactacgacctatggaacacatgctgtcaaagaccaagatacgacggatgcggtatttttggaaaccatctatgggattacgttaagtactcagcctcatggtcacattccgtagaaaactatgatgttggttaccatggattttactgggatgattcgtgggtgcatggcgtgcctcatggtaactactactacccgctttggaattactgctgtcaacatccaagatgtaataggtgcggaatttttggccatcacttgcaggactatgttaagtactccgcatcatggtccacctctgttgagaactacggttacgatgtcagttatccgggtttctactgggataactcttgggtgcatggtgtgccacatggaaatcactattaccctctatggaactactgttgccaacatccaagatgcaatagatgcggaatcttcggacaccatctacaggattatattaaatactctgcttcttggagtacttcggttgagaattatggttacgatgtcggctacccaggattttactgggacgactcctgggttcatggtgtcccacatggaaatcattactatcctctctggaactattgctgtcatcatcctaggtgcaaccggtgtggtatttttggccatcatttgcaagactatgtgaagtattcggcttcttggtctacgtccgtcgaggactacggtggatacgattacgacttctactgggacgactcttgggtacatggcgttccacatctaggtacgtcttc

SEQ ID NO: 2347 - DNA, 837 bp, Artificial Sequence
  Description of Artificial Sequence: Synthetic polynucleotide
gaagacttaaggtcgaggtctgggcagaggtaaacacggctggggaggacttggacacggaggactaggaggtttgggtcatggaggactgggtggtctaggtcacggtggcttgggaggactgggtcatggcggtttgggtggcttgggttccgactctggcgacttaggcggaataggcggtctgctgggaccaggtggtcgtagaggttggggtcgtcgaggcccgggtaagtattctgcttcggtgagtatttctcattctatttctatcgaacgagtaattacacctggcgtttacacttctatacatagatcggtttctgtttcgcactcagtctcggtagaacatagaaggagaatagctccaattgtcgtggactattccatttcgtctagtcttagtatctcaggcgaaggaagaggacttggaagaggtaagcacggctggggtggcctcggccacggtggactaggtggcttgggtcatggtggcctaggaggtctgggacacggaggtttgggaggtttaggacacggtggacttggtggccttggaagcgattctggtgatttaggaggtattggtggccttctgggcccaggaggaagaagaggttggggcaggagaggtccaggaaagtacagcgcttccgtttccatttcccactctattagtattgaacgagtaatcacgcccggagtttacacttcaatacatagatctgtgtcggtttcacattctgtctctgttgagcatcgtaggagaatcgctcctattgtagttgactactctatctcctcctcattgtccatttccggagaaggtacgtcttc

SEQ ID NO: 2348 - DNA, 837 bp, Artificial Sequence
  Description of Artificial Sequence: Synthetic polynucleotide
gaagacttaaggtaggggacttggtagaggcaagcacggttggggtggcctgggacatggtggtttgggtggtcttggacatggaggtttaggaggcttgggtcatggcggactcggaggtctgggtcatggtggactcggtggtctgggttccgactcaggagatctgggcggaatcggtggtcttttgggacctggtggtcgccgcggttggggcagacgtggtccaggaaaatattccgctagtgtttctatatcacactcaatctcgatcgaaagagtgattactcccggcgtttatacttcaatacatagatctgtttcggtttctcattcggtgtcggtcgaacatagaagaagaatcgcccctatcgtcgttgattactcaatatccagtagcttgtcgatctccggtgagggcagaggtcttggtagaggaaaacatggttggggtggcttgggtcacggtggacttggcggtttgggccatggaggtttgggaggactaggccacggtggtcttggtggcctcggacatggtggacttggtggtttaggaagcgacagtggtgaccttggaggaatcggaggtctattgggtcctggtggaagaagaggttggggacgtagaggtccaggtaagtactcagcatcagttagtatttcgcattccataagtattgagagagtcataacacctggtgtctacacttctatacacagatccgtctctgtgagccactcagtaagcgttgaacacagacgtagaatcgcaccaattgttgtagattacagcatctcttcaagcttatctatttctggagaaggtacgtcttc

SEQ ID NO: 2349 - DNA, 675 bp, Artificial Sequence
  Description of Artificial Sequence: Synthetic polynucleotide
gaagacttaaggtagaggtctaggcagaggaaaacatggttggggtggcttgggtcacggcggtttaggtggactaggacacggtggtttgggtggtttaggtcacggaggactcggtggtctgggacatggtggattgggtggtctaggtagtgattccggtgatctgggtggaatcggtggattgttgggtcctggaggaagaaggggatggggtagaagaggccccggaaaatatagtgcaagcgtctccattagccattccatttcgattgaaagggtcattaccccaggcgtttacacttcaatacataggagcgtgagcgtctctcacagtgttagtattgaacgacctcgccgtatcattagtcctgtcgtagattattcattatcaatctcagcatcctcctctgtttctgctgaaggtggccgtcgtagaagattacctggatcctgcggtactattatttccgattcttcgagtaacgttggtggccttggaagaattggtgctctacacaagttgggtggaggccgaatcccaagacctgctatctataccagacaccctggactcaaaggattaaagccacaatgtcctctaagtaactttaatgttcatgtcaaagtaggaaacattagaaaagccaatggtaactgcggaggtacgtcttc

SEQ ID NO: 2350 - DNA, 789 bp, Artificial Sequence
  Description of Artificial Sequence: Synthetic polynucleotide
gaagacttaaggttccagtgtaatcgacaagttggaagatttactgactcacggacaccatggtcaccattgggaaggcacagatggtttgcacgaaaaattgctgcaggaggatgacgtcattgaagccaactccaagggagagatcattgaaaaaattatctctagacgcgagattattacagacgataattctgaatctgaatcagattcagattcttctgaggactctggcagcacagagaagatcatcaagcaaattatcatcgtccaagagaagccgaagcatggacaccaccacgctaaggaaaagatatacgaagaagaaattattattaagaaaattggtgatttgcctaaaaaggattgtgatgaaaataagcctagagaagtaacttcgtggcgtcacactttacctaatagaaaaagtatttcaatctcaaaatccatctctattgaacaaataatcaaaccacatgtcatcacgagaatccgcacttctaagtctagttccttgtccatttcggtggagcgtcctagaagaataatttccccaattatctcgggtggttggaacagacacaaacctagaaagtacagcgcatcttcttccattagtaagtcgatctcaattgaaagggttatcactccagctgtgtggaccaggattcacaaatcagtgtccgtttctcattctgtttcagtagaacatagaaggcgaattgccccgatcgttgtggattactctatcagttctagtttatctatttctggtgaaggtacgtcttc

SEQ ID NO: 2351 - DNA, 1293 bp, Artificial Sequence
  Description of Artificial Sequence: Synthetic polynucleotide
gaagacttaaggtagaagaagaggaccgtggggatacggcagaggattgtctggatccggtgacctagacggcctaggtggtgtgggaggactcggtggtttgggcggcttgggaggcagacggggtccttggggtaggggctatggcagttcgggaaccgttagtgtctctgtttccgtcgaagagggtagacgtcgtggaccatggggaagaagaggcaaagtatcaattagccgttctgtttccatcgagagaattgtaacgccaggtgtgtacacacaaatctccaggtcctcatcagtttctgtggaaggaggaaggagacgtggtccatggggacgaggttatggacctactggttccgtgagcgtttcagtttctgtagaaggtggtcgaaggcgaggtccttggggttatggaagaagattaggaggattgagcggtagcggagatttggatggcctaggtggtgttggaggtttaggaggactaggaggtttaggtggtaggcggggtccttgggttagaggttatggcagctcggtgtcagtcagtgttagtgtggagggtggtagacgacgaggaccgtggggtagacgaggtaaagtctctattagccgttcaggatctatcgaacgtattgtgaccccgggagtatacactaagatatctagatcatctagtgtgtccgttgaaggtggccgaaggcgtggtccctggggacgaggctacggtagctccggctccgtttccgttagcgttgaaggtggacgtagacgaggcccttggggaaggaggggtaaggtgtctatttctagaagcgtatccattgaaagaatagtcacccctggtatttacactaaaattagtagaagctcaagtgttagtgtcgaaggaggcaggcgcagaggaccttggggttacggtagaggactaggtggactctccggctcgggcgacctggacggattgggtggtgtcggtggactaggtggattaggaggtttgggaggacggagaggaccttggggacgtggatacggatcttcgggttctgttagcgtttccttatcggtcgaaggtgtgaggagacgcggaccttggggtagaagaggaaaagtctccatctccagatctgtctcaatagagagaatcgttaccccaggaagctacagcaagatttcccgttcctccagcgtttccgttgaaggaggaattcgtagaggcccatggggcagattcggtggttttgtttcctccggttcttcatcagtcgagtcaggtacgtcttc

SEQ ID NO: 2352 - DNA, 2223 bp, Artificial Sequence
  Description of Artificial Sequence: Synthetic polynucleotide
gaagacttaaggtcctattgcaaactttgttggattcgtcatctctttgcttttctctttattcgaggtgatggtgtcagtcgttttcgacgtaaagtcctttacctctttgagcactccaacttgtaattctacggtgccatccttcgccactagagtcggtggtggtagattcagcggtatcataactgcttccttcaacatgatagctatgatcagtgctaacgtgcaagcaatacaatcaggctctggaagtaccagtggatcatcgtcctcctctactacatctacctccaacagtacaactactacttccaactccaccaccaccacgactaattcaactactactactagcaattccacatcctcttcaaattccacctcaagtggtcttacaagcagtgctagcgttgtctctctgatagatacaatcgcctgggtgtaccaggactcttcggttggaattgcttacttgatggtttctattttagctcttttctatggacaaagcgtttcagctccaccataccctgaccttggcattccagccttgccggctaattgctccggccctggagtcccacagtctgttcaaatcagagccgctattgcatatgtgaacatcacaatttacttcattaacatgacaggacaacaatttgaggatctacaaggtcccgttgccactgattgtggctgcccaaacacgacaagcgttgctccattagtccttgagtgggaagctatcttggctgccttgcaagccctggcaaacagtaccgcttctgctaacagcacgacttcatcaaactcaactaccactactacaaccaactctacatcaaccaccactacaaattctaccacaacaactaactcaacctcctcgtctaattcgtctaccatagctggatgtattgatatatctgcgaacttaactatcgctttgcagaacttgcaggctcttctattgcaagagagcacttgtgctccagcactcgctgcaaatgccaagaagtcgggagtgagggatatgtccccttgtaagcctggaaaaacagcaagtggatgtgccaaatctggcgaaaaaaaagttaaaagaaaggctaggctcgaaaagatgcgagcaaagtgccgtagagcggttggtaacagaatgaaaggatcaatgaagaaacgtgtgagatcacgcgccaagaagttcggtaaggccgcaaagtcgggtgtaaggcgctaccgaaaaaatattaaatacgtgtatatcccacctgttatggcctcccttaatgcttacgctgctctgatggcttcgttgtctgaatcaatttcttctcaatccgattccgctcttaactcgactgatcaagcctgtaactcaactggatctaacacggatgcagctgttattgctgctacgaacaacgtcacagacatgttcgcaaattttactgcaatggttttgaataatactgttgcttacccaaactgcacacagtttgctgatatggctttgctaatgatctctcagattaacgatcagatcatttcttgtggctcgcagtctgatgatgctgagtctagcatatactttaatgtaacaatgaatatcgtcgctatggctcaagagtataacaacttcgcttccatgtctgacaagtgtacaagatctttcgcgaattcttggctctggatgtatattaagtgggtgttttatcggatgggaatgacatcgggaattccaaattttctggcctgccaaactaaggctgagagttctctaactgcctttctggcatcatttaatgctactatcaatgccacaatagcagctgcttcggctaactcatcctcggttcagagttccgaagcttcttgcattgagagtagtctatctgacgcctcagctatcttggcaatgtatgagaacgcttaccagaactgcgtcgcacctggttccgttcctgatgctgccaatacaactacaacatctacgactactacgaccacaacaacaactactgctgccccaacgactactaccactaaagctgcaaacgctccattcacctacccactatgtaacctccagatgacggctgcttgcgtggcggctctaccaacatgtacctacccattcatttcatcagctggatgttgtccatctggtaagaccctaaacaccggtctgggtggaaggggatgttgtaaaggtacgtcttc

SEQ ID NO: 2353 - DNA, 915 bp, Artificial Sequence
  Description of Artificial Sequence: Synthetic polynucleotide
gaagacttaaggttgcgagtgtggatgcgctgagctgaattgtccgcagaataagaaaccaaacaaagaaacatgcgagtgcgaatgtaagattctggctaagtgtaacgacggacaagtgtttaacaaggacacgtgttcttgtaattgtcctggaagcgcttcggacaaagtctgcaagaagcctcaaatctacaataacgagtcttgtaaatgtggctgtccggtagatatgcagaaaccaattgacggttgccctaggcctcaaagatgggagtctgattcatgtagttgcgaatgccctcttaaacaagattgcaaaaatggtaaagtgtgggacgcaaccatctgccaatgtatctgtcctcgtgatgcattgccatgcgctgctggtaaggaacgatgtggagaatcttgccaatgtaaatgcatcaatagagagccaaaagaaggatgttcaaagtcacttgtctggaatgaggacaaatgtgaatgtgtatgcccagcaggtaagcagatgcctgttggtggttgcgagtctggtaaatcctttaacgcattgacatgtcaatgtgagtgtgacgagtccgcttcaaagtgcggaaacaaacgttggaacgcggatacatgtaagtgtgaatgtcaacctggaaaaccgccagaaggttgtggcaagcaaacctggatctctgaaaagtgtaaatgcgaatgttctcctgctattacctgcgaggccccacaaatcttggatccaaacacctgtgagtgcaaatgtcctgtcaatatgcttgccgaaaaggagaaatgtaaactaccaagacaatggacagactccaaatgcttgtgtcaatgtcctaccgccccagtgacttgtgaaggtaaagaaacctggtgtggtgaaacaggtacgtcttc

SEQ ID NO: 2354 - DNA, 912 bp, Artificial Sequence
  Description of Artificial Sequence: Synthetic polynucleotide
gaagacttaaggttgccaatgtgagtgtaaaaacaaacaagagatggctaactgcaaatctccaagaacatggaactatgacacttgcaaatgtgattgcaagaacgcggatgattcagatgattgtgttaagccacaaatttggttggataaccaatgtaaatgtggctgcccagcatcagcccagatgacttgcgccgacaacaaacgattcatagaaaagtcttgtaagtgcgaatgcaagttagctatgcctgccactattccgccaggaaaaaaatggaacgaggataaatgtgtcctcgaatgtgcaaacgttaagacttgtgagggtcctcagagatggtgcgataatcagtgcaagtgcatctgcccgcaagttaacactaagtgttcggacaagcagaagtttatcgagtctaaatgcgagtgtggctgtgacacgcaaacgcaatgtaagaacggattcagatggtctaacttagagtgcggttgcctgtgtgatgagaaaaaatgccagggtaagcaagtgttcgacaagaatacttgtcagtgtaaatgcccaaatcaaaagccaggtgacacatgcggaaacggaaaagatttttgtccacttgattgttcttgtaaatgtaagtctcctaaaccagctaatggctgccctggtgttcaagaatggaacgaagaaaaatgtcagtgtgagtgtcctaaggacaaaccaaaaaagcaatgtcctggaggtcaagattggaataaccacttgtgtcaatgtggatgtccaactcctgcgcccacttgtagcaataagcagaagtacagtaatgtttcttgttcttgcggttgtaagcccggtaaacctaaggaaggcagacctggtaagcaaatctggtgcgaaaacacaggtacgtcttc

SEQ ID NO: 2355 - DNA, 918 bp, Artificial Sequence
  Description of Artificial Sequence: Synthetic polynucleotide
gaagacttaaggttgccagtgcgaatgccctaaaccaatgcctacggagggttgcggaccacaaagctggaacggagagtcctgtaaatgtgaatgcccttcatctattacttgttcctctcctcaaattattgacaaagatacttgtgagtgtaagtgccctaaaaatatgctagctgataaggaaaaatgcacggccccacgacaatggatcgattcaagctgttcttgcaaatgccctaccactccagctgtgtgtgagggtaaccaaaaatggtgtgacgaatcctgccaatgcacttgccctggtggtaagaaagagtgcggtgacaacaagtactttgatgagtcaagttgtgaatgtaagtgtaagtctaatcctacctgttcggacccacaaatttgggatgctgacgactgttcgtgtaagtgtccgaaggataaaaaaatgccgaagggcggttgtcttaatggacaagagtggaacaaactagcctgttcctgtggttgccctgaaccacgtcctgtttgtactgacgagcagacatataacaataatacgtgtaaatgcggttgtggcattgacaagccttcatgcccgaagcaacaaacttacaattggaataagtgccagtgtggttgtccagaggaaatgaagaagccagccggaggttgcggtgctaagacatggttggaagaagattgtcagtgcaattgcgttcctggtaaacctgctggaggttgcttgggtgctcaaaagtggtgcgacgacgaatgtatttgtaagtgcagtaacagtgaaccagccaagggatgtggaaataaacagtggtctgatgtcagttgtgattgtgagtgcccaactaaaaagacctgtgcggatcctcaggtttgggacgctaacacaggtacgtcttc

SEQ ID NO: 2356 - DNA, 879 bp, Artificial Sequence
  Description of Artificial Sequence: Synthetic polynucleotide
gaagacttaaggtccatacggcgacggtttgggtccaagaggatatagtgcgtccgctagccagtccggcgaaggcggttggggatacggaccttacggcggtagtcttggaccatatggaggttccttgggacctagaggatactccgcttctgcctctagaagcgttgagggaggatggggttatggcccttacggaggcggtgtaggtccatatggtggaagtttaggaccatacggagatggcctcggaccatatggctctggagtcggtccgtacggtgatggattgggaccatacggaggtggtgttggtccatacggagacggacttggtccttatggcggatctttaggtccttacggtgatggattaggtccttatggtggaggagtcggaccttacggtgacggtcttggaccatacggcggttctttgggaccatatggtgatggactcggtccaagaggttactccgcctccgcatcccagtccggtgaaggtggctggggttatggcccatatggcggctcactcggaccatatggtggttcccttggaccacgcggatactcggcatctgcttcacgtagtgtcgagggtggatggggttacggtccgtacggtggaggtgttggcccatacggaggaagcctaggaccttacggagacggactgggtccatatggatccggtgtaggaccttatggtgatggtcttggtccttacggtggtggtgttggtccttatggagatggattgggtccatacggaggatctttgggaccatacggtgatggtctgggcccatacggtggcggtgtcggtccttatggagacggattgggtccttatggtggctccttaggtacgtcttc

SEQ ID NO: 2357 - DNA, 981 bp, Artificial Sequence
  Description of Artificial Sequence: Synthetic polynucleotide
gaagacttaaggttccgcaggagcctctagtaacggatccgttgctggtgcatcaaaaggtgccgcaggagcttcaagtaacggttcatccgcttcagctagtaagggaagtgctggagcaagttcaggatcgtctacggccactgccagtaaaggatccgctggagcctcttcaaatggttcatctgcttcagctactaaaggatcggctggagcttcttccggaaacagtacagccgtagcctccaaaggcagtgcaggcgcaagtagtaatggcagttctgcttctgcatctaaaggttctgcaggagcctcttctcagggatcgtctgctagtgcgacaaaaggatcagctggcgcgacctcaaatggatctagtgccgtcgctagtaaaggttcggccggtgcttccagtggaaacagcactgcttctgccactaaaggtagttcttctgctagtagtaacggaagctctgctggtgcatctaaggacggagctggcgccgctagcaacggttccacggccgtggcgtctaagggttccgctggagctgcctccggcaacagtactgcatccgctacaaaaggttcctcctccgctagctctaacggatcctctgctaccgcctccaagggttccgccggagctacttctaatggatcctctgccgttgcttcaaaaggaagcgccggagctagttccggaaattcgacagcttcagcatcaaaaggttctgccggagcttcttcaaacggatcttcagccacagcaactaagggatcagctggagcaacctcaaacggaagctcagctgtggcatcgaagggatccgccggtgcttcctcaggtaattcaacagcaagtgcttcaaaaggcagtgcgggtgcttcgagtaatggatcatcggctaccgcgacaaaaggttctgctggtgccacatccaatggttcgtcagctgtggcatcaaaaggtacgtcttc

SEQ ID NO: 2358 - DNA, 498 bp, Artificial Sequence
  Description of Artificial Sequence: Synthetic polynucleotide
gaagacttaaggtcatccaacagattgcggcaactcaggaggctctagtggctcatctgctgcatccggagccgcttcctcttctggatcgggttctgcagctggatcaggtgcggcctcaggttccggagcagcctccggatctggagcagctagtggtagtggtgccgcttcaggtagtggtgctgcatcgggtagtggcgccgcaagtggctctggcgctgcatcaggaagtggcgccgcatctggcagtggcgctgcatctggttcgggagctgcctctggttcaggagctgccagtggatctggtgctgcttcgggctcaggagcagcgagtggttcgggagcagcttcaggctcgggatcagcttccggctccggtagcgcttccggttcaggatcctcttctggttcaggttcctctggttgtggatcaggaggctcagcatcaggatcctccggtggttcctcagcttcggcttctaaaggtacgtcttc

SEQ ID NO: 2359 - DNA, 579 bp, Artificial Sequence
  Description of Artificial Sequence: Synthetic polynucleotide
gaagacttaaggtagtgcgggtgcctcatctggtaactccacagcttcagccagcaaaggatcagccggtgcctcttcaaacggttcctcagcaactgcttctaagggatctgcaggagctacctccaacggctcatcagcagtagcttccaagggtagtgctggtgcgagttccggcaatagtactgcttctgcctcaaaaggatccgctggtgcatcgtctgatggttcatctgcttcagcatcaaagggcagcgcaggagctacttctaacggctcctcagctgtcgcttcaaaaggctctgccggtgccagctccggtaattccacagcctcagcttcaaagggaagtgctggtgcttcctcaggaggaagtaccgcggcagcctctaagggatccgcatctgcaagtagcgacggtttttcagcagcttgtgactccggtgaatctgaggcagtggacaaagcgaacctagcagccattgccaatattgccgctgcagcaggtaagccagccgcatgtggttccgcaccaccttctgacgactattacgattacggttgtggaggtacgtcttc

SEQ ID NO: 2360 - DNA, 789 bp, Artificial Sequence
  Description of Artificial Sequence: Synthetic polynucleotide
gaagacttaaggtagctcggctagtgcctcgaaaaactccgctggtgccagctcaaacggctcatcagccggagcaagttctggttcagccggtgcttcgagtggtggatcttctgcatccgctacgaagggctcagctggagcatcgagtggcggaagttccgctggcgcatcaagtggttcagctggcgcttcttccggcggctcttctgcctccgctaccaagggatccgctggtgcttcctctggttcaagttccgctggtgcatccaatggtagtgctggtgcatcctccggaggttctacagcaagtgctacaaaaggctctgcaggagcatcctcaggaggatcgacagccggtgcatcgaacggaagtgcaggagccagtagtggtggatccagcgcatcagctactaaggaaagtgcaggcgcctcttcaaacggatccagtgccggcgcctcgaacggcagtgctggtgccagttctggtggttcatcagcttctgcaactaaaaactcagctggagctagctctggtaattcctctgcgggcgcatcaaatggttctgcttctagcagctctggatcctcctcctctaccgccacaaaggaaagcgccggtgcctcgtctaatggcagcactgcttctgcaagtaaagatagtgctggagcttcatctggaggttctagtgctggagccacctgtagcggagctggagctgcttctggaggttccgtctcaagtgcaactaagaattcttccgctgcatcttcacaaggtacgtcttc

SEQ ID NO: 2361 - DNA, 885 bp, Artificial Sequence
  Description of Artificial Sequence: Synthetic polynucleotide
gaagacttaaggttcctcaggtggtgccacttcttccgctggcgctggatcagcttctggctcctcgggaggaagtacttcgggagcctccgccggatcggccagcggatcttccggtggatctagttcttcggcgggtagtggttctgcctccggtagctctggcgactcgtctagttccgccggatctggaactgcttcaggaagtagcggcggtgccacttctagtgctggcgcaggatctgcctcgggatcctccggtggttctacatctggagcaagtgccggatcagcatcgggctcttcaggtggaagttccagttcagcaggttcaggaagtgcatctggatccagtggcgattcatcgtcatcagctggttccggaactgcaagcggatcttcgggtggtgcaacatcttctgctggagctggatccgccagtggaagttctggaggttcgacttccggtgcttctgcaggaagtgcttccggaagtagtggaggatctagtagttctgcaggttctggaagcgcatccggttcatctggagactcttcgtctagtgctggaagcggaagcgcgagcggcagctcaggaggttctacttcaggagcatctgccggttcagcatcaggttcttcgggtggctcgtcaagttccgctggttctggtagtgccagcggttcatccggtgattcaagttcatcagctggctctggatctgcttccggatcttcatgtggatcaacctccggcgcttccaatggctccgcttcaggaagttcgggtggaagctcttcatctgctggatcaggttcggctagtggatcctccggagattcctccagctctgcaggatctggcagtgcttcaggtacgtcttc

SEQ ID NO: 2362 - DNA, 420 bp, Artificial Sequence
  Description of Artificial Sequence: Synthetic polynucleotide
gaagacttaaggtcaagatagtggatgtaatgtcattgcctaccctactgcttcatgtggtgatagtggatcaggctccgccgcttcttctggtgcggcgagtagttccggctccggatccgccagtggaagtggagcagctagtggtagcggaagtgccagtggtagtggagcggcatcaggttccggatcagctgcaggaagtggagccgcttctggatccggagctgctagcggatctggatcggcctccggttctggttccgcatctggcagcggctctgccgctggttctggcgccgcttcaggatccggtagtgctagtggttcaggtagtagttcttcaggatcttctagttctggatcctcaggaggatgtggaggtggctctggttctgcaagttccggaggtacgtcttc

SEQ ID NO: 2363 - DNA, 507 bp, Artificial Sequence
  Description of Artificial Sequence: Synthetic polynucleotide
gaagacttaaggttcgtcgggcggatcctccagtgcagccggtagtggatccgcttccggagcatctggaggagctacctctgctgcaggaagcggttctgcttcaggatcttctggaggatcttcttcaggagctagttcaggttcagcctctggctcctctggaggttgtggttctggaggaagttccggaagtggtagtggaagtgcttcaggaagcggtagtgcttctggcagtggatctgcatcaggttctggatctgcctctggaagtggagccgctagtggtagcggagctgcttccggatctggcgctgcttccggtagtggagcagcctccggttctggagccgcttctggatcaggagctgcaagtggatcgggtgccgcttcaggttccgccgccgcttctggtgccgcttcttcctctggatccgctagtggctcaggttcaggttctggttctagtgacgattctgaggacgactcttgtggaggtacgtcttc

SEQ ID NO: 2364 - DNA, 651 bp, Artificial Sequence
  Description of Artificial Sequence: Synthetic polynucleotide
gaagacttaaggtgctaatggagcagctgctgcttcagctgctgctgctgcggctagaagagcaggagctattggtttgaacggagcagcgggcgctaatgtagctgttgctggcggtaagaagggcggagccgctggtcttaatgcaggcgctggtgcctcattggtatccgccgcggcaagaagaaacggtgctctcggactcaacggagctgctggtgcaaacttggcagctgctggaggtaaaaaaggtggtgctattggacttaacgctggtgcttcagccaatgtcggtgcagctgctgctaagaaaaatggtgcaataggtttgaattccgccgcatctgccaacgctgccgctgcggctgccaaaaaaggtggagcaattggacttaatgcaggagcctcagcgaacgcagctgcagctgcagctaagaaatctggtgctgtaggtctaaacgcaggagcgagcgctaacgccgctgcagctgccgcaaagaaatcgggtgcagtggctgcaaactctgctgcttcagcaaatgctgcagcggcagcacagaaaaaagccgccgctgatgctgctaatgctgccgctagtgaatcagctgccgcagccgccgctaagaaggccgctgctgtaggtacgtcttc

SEQ ID NO: 2365 - DNA, 621 bp, Artificial Sequence
  Description of Artificial Sequence: Synthetic polynucleotide
gaagacttaaggttccgcttccggttcagctagtggttcaaagtccgaaagtggatctgcatctggatctgccagtggaagtaaatcagagtctggttctgcctctggtagcgagtccggctccgctcaaggtggaggttctaaaagcgaaagtggcagttcctcgggttcggcttctggctctaagagcgaatctggttcggcatcaggttccgcctctggatctaagtcagagtccggatccgcttccggctcaggatcaggatctaaatccgaatcaggctctgcttccggatcagcgtctggttcaaagtcggaaagtggatctgcttcaggtagtgcttctggatccaagtccgaatcgggatctgctagcggaagcgaatctggttcagcacaaggaggtggttccaagtcagaaagtggaagtagttcaggttcggcttccggatcaaagtctgagtctggtagtgcatccggttcagccagcggaagtaaatccgagtccggctctgcctcaggttccggttctggttccaaaagcgaatccggttccgcaagtggatccgaaagcggttcagcagccggaggtggctccaaatccgaatcaggtacgtcttc

SEQ ID NO: 2366 - DNA, 819 bp, Artificial Sequence
  Description of Artificial Sequence: Synthetic polynucleotide
gaagacttaaggtgctgtttacctaagactgtcctctgacggttcatgcccagctgaccaggtttgttgtcgcgaagaggactctaatgaaatctgcggcggtacatgtgtgcctgagggagcctgtgaagccggtggtatcaacctgagggttggaggtgccggaggtggatgtagctttggagagatatgctgtgatttgccgcttaaccgatgcagaggaacttgcactactgtagatctgtgcggtgataataggagagtggacttaagattcgaggatcagctgtgtcctggttcgcaagtctgttgtgagaagtccaagacaaacgctatctgtcacggaagatgcgtcgctgctaatgaatgttcgagatcctctaacttagtggacctgcgtgtacaatcgaacgatggatgcccaggtgacagaatttgttgccagaatacgtgtgagggacaatgtgttccaagaggacagtgtggtgatgatacaaaagacattgaccttagagttggcgattcttcctgtcccgaaaatcaggtgtgttgtaagaatccaagaacctgcacttgcgtcgatccatctaaatgtccccaaatgataaaccttcgctttagttcagaatgtccatttcaccaagtttgctgcgacagcgtcagcgactctaattgtcaaggtctatgtaccccagatgaccaatgtaaggttcgctcaaatggaacctgcagtggtggtcttacatgttgtggtaaaataaagccatcttgtgatggttcttgtgtgtcccttggacaatgcccgacaggtacgtcttc

SEQ ID NO: 2367 - DNA, 795 bp, Artificial Sequence
  Description of Artificial Sequence: Synthetic polynucleotide
gaagacttaaggttgccctgcaaaccagcaagacccgtttgctgtgtgttgtaggaatgcgagtaaactttgtaacggttcttgtgttagtcaagagcagtgcgccgacagtggcttcgatttgagaatatcttctcaaacttgtccaggcaacgctgtctgctgtaagaacctgagcaagtcaccaacaggtaaagtctgccagggaagatgtgtacccagccagcaatgtactggacaatctcaaaactcggtcgacttgaggttttctgaaggtctatgtcctttaaacctagtctgttgtccagcaagtacgtcttgttcgggttcatgtgttgccggtaatagatgcctggacaacgctttgtccattaatcttagacgttcgactgaatcttgccccgcaggattggtatgctgccagaatgttaacaaaggttctacttgtgatggacagtgtaccagtcgtgacagatgcgctgacctcaccttgggaatcaacttgagactatctgatcagtcttgcccatccaatcagatatgttgtaagaaagtcaggaagcctttgcctgatgccgagtgtacctgcgtaatgctagaccaatgcgctgatgaccagagatcaatagacctaaggaccggtggtcaaaagtgtccatcaagaaaaatctgctgcacaaagctaaagaccacagtagaaaaatgtgatggctcctgtatctcataccaagactgtccagaaatagcaaatgcatcttctgttgatttgagattgttttccggaggtacgtcttc

SEQ ID NO: 2368 - DNA, 1152 bp, Artificial Sequence
  Description of Artificial Sequence: Synthetic polynucleotide
gaagacttaaggtgttcctaaagaactgggtacctcaattagctcagcttctgctagtgctagtgcttcagcttccgccaccgcttcgtcctcttcaaagaacgtccatttattgcctttaaaaagtgaacatggaattgtaatcgacaagtctaaatttaacattaggaaagtggtcttgtccgcaattgatgaaattaacggagctcctaatattggtctaggtttgaagcaagtaagcttggctcttgcaaaggctcaagcaagtgctcagtcctccgccgaggccctggccatcattaagaaaattgtcgctctacttattagtgcctatgttcgtgcagcagaagccgccgcaagagcttctgccgaggctctggctactgtgagagccgcagagcaggcacagaagattgctgaggccaagggccgtgcggctgctgaagctctgtctgagcttgtcgaagctagtcaaaaggcagatgctgccgcagctggtaccaccgacgctatcgagcgcacttatcaagacgctagggcagctacttccgcgcagactaaggcctccggcgaggccgaaaacgccaataggaatgctgctgctactttggccgcagtgttgagcatagcaaaggctgcttcaggacagggtggtacgcgtgctgctgttgatgccgctgctgctgcagcagccgccgcggccttgcatgcgaaggccaacgctgtgagccaagcgacatcgaaagcagccgctgaagctcgtgtcgctgcggaagaggccgctagtgctcaagcttcagcatcagcatctgcccaattgactgctcaactagaagagaaggtatctgcagatcaacaagctgcttcagcctccacagacacgtccgcagcaatagcagaggctgaggctgctgcattagcatccactgtgaatgccattaacgacggagtggttattggtttaggtaacaccgcttcttcgtctgcacaggcttcggctcaggcatctgctttagctagggccaaaaatgctagacctaagattaaaggttggtataaaatcggcggtgctacctccgcaagtgctagtgcctcagcttccgcatccgctcaaagctcatcacagggattggtttattcaggtacgtcttc

SEQ ID NO: 2369 - DNA, 1140 bp, Artificial Sequence
  Description of Artificial Sequence: Synthetic polynucleotide
gaagacttaaggttcgaaaagctacttgttaggttcgagtgcctccgcatcggcctctgcatcagcatccgcatctgctggaggttcaactggaggtgtaggtgttggtagtgtaattagtggcggaaacaatattatccgtggtgcttccacaacatcggttactttagccgcagccgctgccgaagcaaaggccgctcttaatgccggtaaggccactgtcgaagaacaaagggaagccttgcaattactgaccgccagtgcagaaaaaaacgccgaagctcgttccttggcggacgacgctgccgttctcgtccagggtgctgcggaagcacagagtgttgctgctgctaaaactgtcgctgtggaacaaggatctaattctttagatgctgctgcagcggaggctgaggccgctgccgccgctagtagagtttccgctcaacaggccttgcaggccgctcaaacgtctgctgctgccatccagactgctgctggctccgctctcacagctcttaaactcgcaagaaaacaagaagctgagtctaacaacgcagccgaacaggcaaataaagcacttgcattatcgcgcgcagctagtgctgctactcaacgagcagtggctgctcaaaatgccgctgcagcttctgctgcttctgctggcgcagctcaggcggaggcaagaaacgcttatgccaaggcaaaggctgctattgctgccctaactgctgcccaaaggaattacgccgctgctaaggcctcagcatctgccggaagcgttgtggctgagcaagacgctcaatctagagctgccgacgctgaggttaatgcggttgctcaggctgctgctcgcgccagtgtcagaaaccaagagatagtagagattggtgctgaatttggaaatgcgtccggaggagttatctctactggaactaggtcatctggtggtaaaggcgtttctgtgactgctggtgctcaggcttccgcttctgcgtctgctacgagctcatccagtagttcgtccggaatcaacaagggacatcctagatggggacataactggggtctgggtagctctgaggcatctgctaatgctgaagctgaatctagtgcatcttcatactcatcaggtacgtcttc

SEQ ID NO: 2370 - DNA, 1296 bp, Artificial Sequence
  Description of Artificial Sequence: Synthetic polynucleotide
gaagacttaaggttctgaattggttggatctgatgcttccgccaccgcgtcagctgaggcatcagcctcgtcctctgcttacggatcaaaatatggtattggtagcggtgcagtgtctggtgcttctgcatccgcatcggcatctgctagcgcctccgcaagtgctagtagtgctccagccatcgaaggagtaaatgttggcactggagtttctaacactgcatctgcctctgctgaggctctttctagaggtctgggaattggccaagcggccgctgaagctcaagctgccgctgcaggtcaagctgctattgctgcaaagtcgtgtgctttggccgcaaaatcaactgcacaggctgtcgctctggttgaaaaagttgccagagctgaagttgaccttgccgagtctgccaggaaggcgaccagattgtcagctgaggcggctaaagctgctgctgaggttgaaaaagacttagttggactcagaggcgccgctggaaaactgaatttggccgctagggcaggcagcaaagcacaggagagagccaatgaagatagtattgaggctaacgagcttgcccaggccactgctgcagctggtgctgaagccgaggctaaggccaatgcagcacaggaggctggtgcaagtgctcttgctattgcacaagcagctttgaatatagaacaagagactgttaaactcacgagacaagcacaaaatacaagactacgatctgagaatatcctggcagccgccagtaatgcgcgtgctattgcttccgcagaggctgaggccagtagtgacctcaacaatagagccaacgcagctagatcaaacgccagggctgctgctgagactcgtgctgttgccacagaggccgcttctaccgccgaaatagccgcttactcttcctcggaaaagggtgaaattaccaacccaggccctctgcctaaaattgtatcggtgactgctggtcttacacagaacgaaattgctggttcaggtgctgctgcatccgctagtgcttccgctctggcttctgctagtgctggagctggtgcgggtgctggcgctggtgctggtgcttcggcaggagccggcgctgtagcaggagccggtgccggtgctggtgccggagcttctgctggagcctccgctggtgctaacgctggagcgggagctagttctttgctattgcctcaatcaaagcttcatccaattagtcgatcctctgcttccgcttctgcatctgccgaagctgaggccaactcttctgcatatgcaggtacgtcttc

SEQ ID NO: 2371 - DNA, 1164 bp, Artificial Sequence
  Description of Artificial Sequence: Synthetic polynucleotide
gaagacttaaggtgttattggtccagacacatcctcttcttcgcaggcatctgcttccgcttcggcttcggctagtgcctccgcatcttcttcagcgagtattggttacaacgagctgcacaaatcgatcaatgctccagcactggctgtgggtgttaagaatggaggtgtagatgtggctaagggagctgccgttgtcgagtcagctatttctgatgttagtactttgactgacgacagaaccttgaacggtttggcaatcataggcaattctgctgaatccctggcaagagcacaagcaagttcttctgcctctgctggcgccaaggctaacgcactgataaaacaatcgatcgctgctatagagatcacggagaaggctgaatatttagcatcgatagttgcgaccaaagcagctaaagcagcggaagcaacggcagccgctaccgctagggctactgccgttgctgaagccgctaaagtttcttccgagcaatttgcagctgaggctagagcagctgccgatgccgaggctaaagccaacgctgcttcaatcattgccaacaaggcaaatgccgttttagctgaagcagcaaccggtttgtctgcgtctgctggaaaagcacaacaatcagctactagagcattacaggcagctagagctgccgccaaggcacaagctgagcttacacaaaaggctgcacagatacttgttcttatcgcagaggcaaaggctgctgtatctcgtgcctcggccgatcaatctgtgtgtacatcacaggcgcaggccgcatcccaaattcaaagtagagcttctgctgctgaatcagcagcttccgcccagagcgaggccaatactatcgccgcagaggcagttgctagagctgatgcagaagctgcctcccaagcacaagcttgggccgagtcattcaaaagagaactgagttccgttgtcttggaggctgaagctaatgctagtgcttctgcttcggcgggcgccctcgcctctggttctagttcaagcggtgcttcgtcaagtgcagatgcaagtgcaggagcttcctcctatggttctctaggaggttatcgccacggtggatcgttttccgaggcctctgctgcagcgtcagccgctagcagagcggaagcggcaggtacgtcttc

SEQ ID NO: 2372 - DNA, 1152 bp, Artificial Sequence
  Description of Artificial Sequence: Synthetic polynucleotide
gaagacttaaggtaaccttcttaaagagtctaaggcatccgcatctgcatctgccagcgcatcggctagagcttcaggtaaaaagaatttgcatgttcttccactaccgaaaaagagcgagcacggtattgtcattgataagagtgtgtttgacataaaagatgttgttctatccgctgttgacgaaattaatggtgccccaaagcttggtttgggatggaagaaagtctctatgggtgtggagagagccgaggctaatgctgctgccgccgctgaagctctggctatgataaaaaagatcgcaatggccagatcctctgcctatgttcaggcagcatgggcatccgctcaggcttccgctgacgcacttgcttctgcccgcgtcgctcaggcgtcgcaggaagccgctgaggcaaagggtcgcgccgcctccgaggctttgtccagagctatagaagcctcatctagagctgatgcagcagccgctgcgacattagatgctatggatagaacgatggaaaacgctagagctgccaacgctgcccaaactcaagcctctggtcaggccgaaaacgcgaatagatccgctgctgctattttagcagcattgctaagaattgccgaggcttctgccctgaataacgaggccgcagttaatgctgccgcagcagctgcagccgccagtgcattgcaagcaaaagcgaacgccgcatctcaagctaccgctcgtgctgcgggacaagcctctacagctgccgaagaggctcaatctgctcaggaggcagcagataaaaacgctgaactgactaccgttatgctggaaaaagcttcggctgatcaacaagccgcatccgcaagagcagactactatacagcttcgactgaggctgaagccgctgcacaagcctccgctatcaatgccttgagagatggaatcgtcgtcggtatgggcaacgacgctggagctagtgctcaggctatggcccaggtggaggccttagcaagagcaagcgaacacaaagcccttggcgagaagaaaaaaggtctggtatggggctacggttcgaaaggttcatcatctgcttccgcttctgcttcagcttctgccgaagcttcctctagattgggcaaggactggggaggtacgtcttc

SEQ ID NO: 2373 - DNA, 1233 bp, Artificial Sequence
  Description of Artificial Sequence: Synthetic polynucleotide
gaagacttaaggttctggtcctcgccttcttggaggcaggagcgcagcttctgcatctgcttcagcgtctgcagaagcttccgcaggaggttggagaaaatccggtgcgagtgcttcagcttctgctaaagccggttcgtccaatattctaagtagagtgggcgcttccagagctgctgcaacattagttgcctcagccgcagttgaagctaaggctggattaagagctggaaaagctacggctgaagaacaacgtgaggcattggaaatgctgacgctatccgcagataagaatgctgaagcccgtattttggcagatgatacggcagtcttggtccagggttccgcagaagcacagtccgtggccgctgccaagaccgtagccgtcgaagaagagtcagcctccttagatgctgcagctgtcgaggcagaggttgctgccgcaacttctaaatcctctgccggtcaggctttacagtctgcccaaactgccgcttctgctcttcgtacttctgctaggtccgccctgactgctttaaagctagctcgtttgcaaggagccgcttcttccaacgcagcaagaatgatggagaaagcattggccgctacacaggacgcaaacgcagctgcccagcaagctatggcagctgaatccgctgctgcagaggccgccgccattgccgctgctaagcagtcagaggctcgtgatgctggagctgaagctaaagctgccatggctgctcttatcactgctcaaagaaacctggtccaggccaacgcacgtgctgagatggcttctgaggaggccgaacttgactcaaagagcagagctagcgacgcgaaggttaatgctgtagctcgtgcggccagcaaaagctctatcagaagggatgagcttatcgagatcggtgccgaattcggaaaagcatctggtgaggtcatctccactggaacaagatcaaatggtggccaagacgctattgctacggcagaggctagttcctcagcttccgccgtaggtattaaaaagacttctggtcattggggtagcggtaaatggagtcgtgtttctaaaggaaagggatgggcttcctcgaatgctgatgctgatgcgtcatcctccagcattattatcggcggactaaaaaggggtggcctgggatctgaggctagtgctgccgcttcagctgaagctgaagcctccgctggaacgttgcttttaggtacgtcttc

SEQ ID NO: 2374 - DNA, 1293 bp, Artificial Sequence
  Description of Artificial Sequence: Synthetic polynucleotide
gaagacttaaggtagtgaacttgagtcggaagcttccgctgctgcttctgcccaggccgaggcctcatcctcgggaagatcaggtaaactgtcggcttcacaggcctctgccagtgcttccgcatccgctagcgctggatctagaggtggatctaaaggtggatggggtcaattacgacgtggagacgtgaaatctgaagctaagtccgctgccgctattgcagtcgagggagccaagatcggaactggaattggaaatactgctagtgcctccgctgaagctctgtctcgtggtctaggcattggacaagccgctgcagaggctcaagctgctgcagctggtcaggcagaagttgccgccaagtcttgcgaattggctgacaaaactactgccaaagccgtcgctatggttgaagccgctgccgaagctgagattgaggttgccaatcaagaggtggctgcggttaagttaagtacgtgggctgctaaggcagcaagaattgttgaggaagattctgctgcagttagagccgccgctggcaagttgttgctcgcagccagggctgcagcagctgctgaaagaagggccaacgaagaaagtgaagcagcaaacgaattagctcaagcttctagcgccgctgcggctgaggctgaagctaaggcaaacgctggaagagaggccgctgccgcagctttggctattgccgaagccgctgttgccattgaacaagaggctgttattctggcaagaaaggcccaggatgctagactaaatgccgaagctgctgccgctgctgctatgaacgcacgtgtaatagcttctgctgagagtgaggcaagtgaggatttggaaaatagagcatccgttgctagagcatctgcagcaggcgccgctgaggctaaggcaattgccaccgatgctggcgcaacggcagagatcgctgcctattcatgggccaaaaaaggagagttaatcaacccaggtccattgcctaaaataatttccgtcaacgctgacctttcaaagtcagaagtcgaggctatgaaaataacccgtggacaagtacaagaagtcaaaaagatttcaacgcataagggtggatggggatggggtaaggagggtagatccaaggtttcatcaaacgcttcagctagagcttccgcttctgccaacgcggctgcaggttcattgggatcaaagtggggtcgtcagttgagtgcttcctctgcctctgctgacgctaatgctgaagctgactctcaactgctcaaagtttggggaggtacgtcttc

SEQ ID NO: 2375 - DNA, 1200 bp, Artificial Sequence
  Description of Artificial Sequence: Synthetic polynucleotide
gaagacttaaggtcgggtgattgagtcctcgtcctctgcctcggcccaagctagtgccagtgccggttctagaggccttttgggtaaaagaccaatcggtaagttggaatggggaaaggaggagaaaaagctcgaagagttggatgaggaatctttaaatgaggccgccttgaaggtaggtatcaagaacggcggccttgatgttgccaaaggcgctgccgtactggaagctgctatgtctgatgtagctacactaaccgatcagagatctcttgtcgatctgggacttggcccagtagctaacgaggccgaaatacttgctgaggcccaagctgcaacatccgcacaggctggtgctgttgcaaactctgctgctgaacgtgcaatcgctgctatggagatggctgataggacggaatatattgcagctcttgttacgactaaggctgcaaaagcggctgaagctacgatggcagcaacagccagagctacagcagctgcttcagcttccaaaatttccagccaagaatctgccgccagtgctgctaacgctgctaatgccgaggccaaggctaatgctgcctctattattgctaataaggctaacgctgtcctggctgaagcagctgcagtcttggctgccactgccgcaaaggctaaagagtccgccatgaaatcgctttctgctgcccaggccgctgctaaggcacaggctagaaacgcggaagcatctgctgaggctcagattaagttatctcaagctcgcgcggctgtcgctcgtgcagccgctgatcaagccgtttgctctagccaagcacaggccgcatcacagatccaatctcgcgcatcagcatcagagtcggctgcctctgcacaatccgaaactaacacggctgctgcagaggccgttgctactgctgacgccgaggctgcagctcaggccgaagcttgggttatgtcattaaaaaatgatctttggttgcaccttaatatgaagggtgaagctaaagcagagggcgaagccgtttcgatctcaaaaggacatcgtggtggaattagaagtggatcaatctcggaggcttcagcagaagcatcctcgaatgtttcaatgggaggacgacatggaagaaaagatctagtctcagaggccttggccggcgcttccgctggatcaagtgcggattccctaggtacgtcttc

SEQ ID NO: 2376 - DNA, 960 bp, Artificial Sequence
  Description of Artificial Sequence: Synthetic polynucleotide
gaagacttaaggttcagtcgagttgggcgccccaaagcaagaatcggtacttgttgagcaattgcttttgaagaatgtggaaacctccgccaaacgcaaagaaaatggagccccaaagttaggcgagtccacggctgctgcacttgcctctaccaaggcaactgctgcagccgaagctaaggccagcgccaaagtgaaggcttctgctttggccttggctgaagctttcttgagagcttcagctgcgttcgccgctgctagcgcaaaggctgcagctgccgttaaagaggctacccaagcccaacttttggcacaagaaaaggcgttaattgcccttaaaacacaatcggagcaacaagccgcatctgcgagagctgatgccgccgccgctgctgctgtttctgctctagagcgcgctcaagcatcttcaagagccgccaccactgctcaagatatcagctctgatctcgaaaagagagtggctacttctgcagcagctgaagctggagctacacttagagcagaacaatccgctgcacaatctaagtggtcagcagccttggcagcacagacagccgctgctgccgctgcaattgaagccaaagctacagcttcgtctgaatctacagctgccgctaccagtaaggcggctgtattgactgctgatacctcaagcgctgaggctgcggctgccgctgaagctcaatcagcttcaagaatagcaggaactgcagcaacagagggatctgctaactgggcctcagaaaacagtagaacagcccaactggaagcctctgccagtgctaaagctaccgcggctgctgcagtaggagatggagcaatcatcggtttggctagagatgcaagtgctgcagctcaagccgctgctgaagtcaaggcactagcagaagcttctgcttcgcttggtgcttctgaaaaagataagaaaggtacgtcttc

SEQ ID NO: 2377 - DNA, 945 bp, Artificial Sequence
  Description of Artificial Sequence: Synthetic polynucleotide
gaagacttaaggtcagagttctccattattagagattgttcaaggaagcgccagtgctaccgcttccacggctgtgactgctagatctggtctgagagctggccaagtggctgtagcttcacagaaggatgccactctgcaggcagacgcttctgccgccgcagctgctgctgccagagcctcagctgaccagtccgcctcattagctcagcaatccgcctctcttcaatctaaggctgccgcacgtgctaaaagtgcagaagagtctgctgccgctaccgccaaagctgagttgcaggcagaatctatagctgcttcagcttcttcaaatgcacgtgaagcagctgcgtccgccaaggctagcgcctctgccatgtctagtgctgctgtccaagccaaattggctgaaaagacagccaaaaaccaagccttggcgtcagaggaagccaaacttaaggcggccgctgcagcttctgctgcagctgcagctagcgccgccgccgaggccgctcttaaagctgagagaattgccgaagaagccattgctaaagctgccgctgcaaaggctgctgctagagcagctgcagcagccttgaattctgctaaagaggctgcaacctcgtctgccaggtcagcagctgaagccgaggctaaatccgaagtcgctatattgatctcagaattggacaagaagtcacgagaggtagctgcctctgcgtcggcaaaagctagagcagccgctgccgcttcctcgcgtaatgcagaaaccgcggttatcggcgcaaatatcaatgtcgcaaaagaggtgcttgcaattccaattgagcctaaaaagttgccagagcctgagttggctcttaaagaagaaaatgttgccgttgcatcttctgagagcgaagttaaggttgaaacatcttctgaagcttggtctataggtacgtcttc

SEQ ID NO: 2378 - DNA, 1035 bp, Artificial Sequence
  Description of Artificial Sequence: Synthetic polynucleotide
gaagacttaaggtaaacctctgattgctaatgcccaaataggtaaggtcaagaccgagacgtcctcttcatcggagatagaaactttggtttcaggaagtcaaacattagtcgccggatctgaaaccctggcttccgagtccgaagcccttgcctctaagtcagaagctcttacctctgaggccgagatcgcttctgtcacaactaaagatgaacttattctaaagggtgaagccatcacaggcaaaaagttgggtacaggtgcatctgaagttgctgccgcttccggtgaggccattgctaccaccttaggtgcaggtcaggcagcagccgaagcccaagctgcagccgcagctcaggcgaaaagtgcagcggcagcagctgctaatgcaggagaaagttccaacagcgcagccgccttggttgcggctgctgcagctgcccagggtaaggctgctgccgcagcggctgcagctactaaggcatccttggaggcagccgatgctgcagaagaagccgaaagcgctgttgccttagctagagctgcttcagctaaagccgaagctttggcctctacagcagctgctgctaatactagagcggctttacaagctgaaaaatctaacgagttggctcaggcagaagccgctgccgccgccgaggcgcaagccaaagctgcagctgcggccaaggctactcagctcgcattgaaggtcgcagaaaccgctgttaagactgaagctgatgctgccgccgcagctgtcgctgctgccaaggcacgagctgtggctgatgctgctgcttcccgtgctacagctgttaatgctatcgctgaagcagaggagagagattctgctcaagcagagaatacggctggagtagctcaggctgcccttgctgccgcagaggcacaagatagctgtattggagcagctgctactcctaggcactcttcttcttatgcttggtggaaattacgcattacctcactcatagtcattctgagccctcgaaacaggagaacaggtacgtcttc

SEQ ID NO: 2379 - DNA, 906 bp, Artificial Sequence
  Description of Artificial Sequence: Synthetic polynucleotide
gaagacttaaggtcatgttgtgaaaagagataaggagcttaaggctccagctcttccagagttactgggagacggatcagacactttaggtgctagtatggagaatggtattaaagttgctagagccagccaaaacgttggactacgtactgagttaaatgctgccgcaagagcagcagccgccgccgctaccaagcaagcaaaagacactgaggctgctgaagctggtgcagccgcagctattgcaatcgccattgccaaacgagaggaagctatcaaagcaagcgaattggcgtctaaacttttgactgccgcagctggttcgtcagaggctgctgtatctgccactgttagagctgctcagttgaccgctgctgcttctgccgctgccaaggctagtgctagtgcttcagaagcttccgccgaagcccaggttagagctaacgccgaagctaatattgcaaaaaaggcctcggccgctgaagccaaggccgcagcagaggctcaagtcaaagccgaattagccaaaaaggccgccgcgggtttcttagctaaagctcggttggctgcctctgcggaatccgaagcaacaaagctcgcagcagaagccgaagttgccttggccaaggcaagagttgctgtcgatcaatcccaatcagctcaagcaaccgccactgctcaggctgctaccgccgttcagttgcaaagtcaggccgctaacgcggaggccagtgctgttgctcaagcagagactttgctcgttacagcagaagcagtcagtgctgctgaggcggaggccgctacaaaggctacgtcatggggcgaggaatgtcatcaaagagaaaaagtcacatttagcgaagatagattgaatgaaagacaagataattggggaggtacgtcttc

SEQ ID NO: 2380 - DNA, 1485 bp, Artificial Sequence
  Description of Artificial Sequence: Synthetic polynucleotide
gaagacttaaggtgacagatcttgggcagctagtgatgcaaatgctgaagcttctgctgctgttgagtctccttctctctgggaggactcaagttcagcttctgccggagcatcaaatgcggcagaaagctcaagcctctgggaagattctagttcggagaataccggagcctctaccgccgctgagagttcttccttgtgggaggattcaagttctgccagtgccagagcgagcacagcagctggttcgtcaagtgcgtgggaagattcttctataaccaacgcgagagagtctggtgcttcgggttcactctcatcctgggaagattcatcttcagcatctgcttcttcctccaccagtgctagtgcttctagttcctccagtagttcttcctcgatttcttcttcagccagtagcagctcatctgccagtgcaagcgccagtacagaggcctctaatgagtcaagaaggggcattgctatcgaaggagctttggttggtacgggtgctgcgagtacggctgcagccagtgcggagatgttgagcgacacattgggacttggtcaaagcgctttacaggctcagacagcatcagtcacgcaagctaatattgcatctgacgcttcgaaccaggccaatcgcttggctgccgccgctgccgccgctatgtctgccgcagcctcagcacaagagaatgctgctagcctagcaagagcttcggcatccgcctctgaaagcgctgcttcagcatcttcaaaggcagaagcatctgccgaggcagcaaagtctagtgccgaaaagtgtcttttacttgctcagaactcagctcaagctcaagccagagctactgagcaaagcgagtcatctaatcgtgattctgcagcaaacgccgcagctgcagcagaggcagaacgtaaagcaacactcgcactgaaagctattgctgatgctaaggctaaggctggagttgccgtagccgcccaatctgaagcagccgcagcagcagccgctgctgccaaggctagagctgatgctgaagccggagcaaacctagctgcagctgcaagagctgtggctgccgctgaggccgctgccagtcggcgaaatgaccgtcaagccggtattgcacaagcaggagcttctgcagctgcagagacaagggcattagcttcttccgccgctgccactgctaaagccgccgcttacgcgaatgccgatatccgtgcactaagtgctgcggctttagagtcctctatctcaagttcttcctcaacttccgcttctagcgcttcctcgtctgcttcctccggagccagtagtgactcctcatccggagcaagtagtggagcctcttctgactcttcctcgaattcctcttctgattcatctagtttgcttggtgatgatgcttccacaagcgcttcatccaccgcagaggccgaatcccgaacctcttctcttattcttaatggaggtacgtcttc

SEQ ID NO: 2381 - DNA, 993 bp, Artificial Sequence
  Description of Artificial Sequence: Synthetic polynucleotide
gaagacttaaggtaaaagagctcgaagaagctctaacgccgaggcatctgctgccacttctacttcgtcacaagccgactcaggtaagaacaaggatgcctgcgcttctgacgccattgccggtgcagctgccagtgcttcttcccaagcatctatcctcggtaagagagcaagaagaagctctaatgcagaggccagtgctgcaacaagtacatcatctcaagctgactcaggtaaaaataaggatgcttgtgcatctgacgcaatagccggagctgctgcttcggcttcatcacaagctgattccggtaaaaacaaagacgcttgtgcctcggatgcaattgctggtgctgctgcctcggcttcatctcaagcctctagtttgggaaaaagagtcagacgttcttctaacgccgaagcatccgcagctacgtctacaagttcccaagctgactccggcaagaatacggatgcttctgcgagtgatgctattgttagtgtagccgcctccgtttcttcgcaggctgacagcggaaaaggtaagtccgcaggagaatccaatgcagaagcctctgcggccgcgtccgcgtcctctcaggctgactctggaaagggcaagagcgccagtgaatccaatgctgaagcctccgctgctgcatctacttcctctcaagcagatagaggtaaagacaaggatgctagtgcttcgaacgctgaggccagcgctattgcctctacttcgtctcaagctggaagtggtaagggcaaaagcacttctgaaagtaatgctgaaacgtccgctgctgcgtccgcttcttctcaagctaacacgggaaaagataagtcaacaagtgacagtaacgctgaagctagtgcagcagcttccgcttccagtcaggcagatagaggcaagggcaaagatgcttccgaaagtaatgcagcggcctgggctgcatctgcttcttcccaatctgataactcaggtacgtcttc

SEQ ID NO: 2382 - DNA, 501 bp, Artificial Sequence
  Description of Artificial Sequence: Synthetic polynucleotide
gaagacttaaggtgcatcaaacgccgctgaatcttcctctctatgggaggattctagttcggaaaatactggagcttcgacagcagccgaaagttccagtctttgggaggattcctcctccgcctctgctagagcttccactgcagcaggaagtagttcagcttgggaggactcctctatcaccaatgctagagagtccggagcatctggatctctcagttcttgggaggattcgagttccgcttcagcaggcgcttcaaacgctgctgaatcgtcatcgttgtgggaggactcttcatctgaaaatacaggagctagtacagctgcagagtcctcatcactttgggaagattccagttctgcttccgcacgagccagcaccgccgctggtagttcttccgcttgggaggattcttctattactaatgcaagagaatctggagcaagtggctcgctgtcaagttgggaggatagttctagtgcatccgcaggtacgtcttc

SEQ ID NO: 2383 - DNA, 858 bp, Artificial Sequence
  Description of Artificial Sequence: Synthetic polynucleotide
gaagacttaaggtatagcgattgagggagctttggttggtacaggtgcagcctctacagctgccgctagcgctgaaatgttatctgacacattgggtttgggtcaaagcgcccttcaagctcaaacggcatcagttactcaggccaatattgcttccgatgcatctaaccaggccaacagattggcagctgctgcagccgcagctatgagcgcggctgcctctgctcaggaaaatgccgcctccttggctagagcatccgcttctgctagtgagtctgccgccagcgcttcgtcaaaggcagaggcttctgccgaagccgctaaatcatccgcagagaaatgtttgctgctagcacaaaattcagcccaggctcaggcaagagctacagaacaaagcgaatcttcaaacagggattcagctgctaatgctgcagcagccgctgaagctgagagaaaagcaacactcgctttgaaggccattgctgatgctaaggctaaggccggagttgctgttgctgcgcaatctgaagccgctgcagcagcggcggctgccgctaaggctagagccgatgccgaagctggcgctaatctggcggctgcagctagggccgtggcggccgctgaggctgctgcctctagacgaaatgaccgtcaagctggcatagcacaagccggcgcttccgcagccgcagaaactagagcgctagcctcttctgctgctgccactgcaaaggccgctgcttatgcaaatgctgatatacgcgccttgtctgctgcggctctagagtcctctatttcatcttcttcctcgacttcggcatcctctgctagtagcagtgcatcttcaggtacgtcttc

SEQ ID NO: 2384 - DNA, 1086 bp, Artificial Sequence
  Description of Artificial Sequence: Synthetic polynucleotide
gaagacttaaggttcatctagttcctccgccgagtcctctgcctcggccactgcatcatcggatgcaagttggtctgcctctagtagaagttcggctactggtagagcacctaatgttatcttgaaccgagccccacagctaggagctagcgctgctgctattgcgagtgcacgtgcatcaactagtgctaatgctgcatctgatgagaagtctgcccgtgaaacccgtgctactgccttggctagatccagagctgctgtaactgcagccgcaagggcagcagctaggacgcaggaggcagtagccgctgcgaaggcagccagcagagctcaagctcttgctgctgccaagtcgagcgcggctatctcggccttagctgccggtgaagccgcagcacaaaaggccgatgctgctgcgttggccgctttggctgctaatcaaagatcagtaaaagctgctgaaaacggattggctgtacagaacagagctaacggagaggctgagcaggcgtcaagagctgcagctgccaacttggctgcagctattagaactagagataatgctttggaaacaagaagggaagctgcaaggttaaaagctctagctaccgccgctgccaacgcaaataataaggctacttctctagctgaagcctctgcaaaccaggcagctgaggcctcctcagcggcggaggatacttcatctgctcaaagcgcagcagttgcccaagcggaagctgcagaaacattgaatgtgaatttggccattctagagtccacccaaagcagtcgtcaggactcaaatgttgcgaaggcggaggcctccgcagcagcaaaagcatcccctggaaccgccaccagagatggcgtaaacttgggactggcctccgacgctggcgctgctgcacaattgaaagcccaagccgctgcactggctagagctagctctagaatcagttctggtccagcactatctgcttggaaatggagaaatgaagattcctcagaatctagcacttccgctatcgcttcgtcgtccgcttctagttcgagttcatctagatctgcttcaggaggtacgtcttc

SEQ ID NO: 2385 - DNA, 1398 bp, Artificial Sequence
  Description of Artificial Sequence: Synthetic polynucleotide
gaagacttaaggtgctgagagttcttcttccagtagtgcagcctcttctgcatcatcaagcagctccgagagtcgaggtcaacttttgcttcctttagaaagatccagcactagatcattgttagaccttgttagctctgcccgatccaacactgctataacagcttcaagcgctgctgccgccaaagctactttacgtgctatcaaggctgcaaattccgctcaaggtgaagctttagcacaagccactgccagtgctgcttcaaatgcaaaagcacgtgctactgccgcagctgcagctcaggcaacaaatgctgcggttaacgctcaaggtaaggccagcgcacaagcaatagctaccgctgaagcagctgaagctttgacgaaatccgcattacaagctcagagcgctgcttcctcatcgaaatctgaggctgctcaagcctccacgtcagccaatgcaggcgctggtgcattggccactgcttccgctcaggccttgtccgccaagaaggccgccctcgcttatgcttccgctgcagcagatgcttctaccgcagctgctaaagcaagagctgcagtggctgccgctgaagccgctacacgtaccgctgtccaagctgaaagagactccacaaacgctgcctcccttgcagctaaggcacaggccgaagccagagctgccgccgcagccgcagctgctgctagattagccgcttcagcagctgctgacgcttctgcccaagctgatgcaagggtccgtacagcttccattgaagctgccgcatcagcgcgtacgaaagcttccaatgcgcaggcgacagctgaggcggctgcaatcgctagatccagtagtagagacgctcaagctaactgggtggataataggtcctcagctagctcctcctcagccagcgcttctgcctcggtgtcagcttctgctagcggagaggcagattcagaggccgacagtgatgcttcagcctcagctagaagtgcagctgactccaatgccggctcaagttcaggtctggctgccgactctgctgcagacactgctgcaggatcaactgccggttctgcggctcgtttatctgccggatcagccgctggctccatagcgagaagcgcagctggttctactgctggctcatcaacaggcagtggtgctggagcatctgctgaaggctccagtaacgcatcttcgggcacttccgcaggagcttcatcaggtgctagtactggagcatccgctggagcttctgctaccgcgagtgccgataactcagctgataattctgctgaggcactttccagttcgtcagctgaaagctctagctcctcttggtcatcttcatctcaaaacatttggtcccaagactggggaggtacgtcttc

SEQ ID NO: 2386 - DNA, 1083 bp, Artificial Sequence
  Description of Artificial Sequence: Synthetic polynucleotide
gaagacttaaggtccatcaaggttgtcggaaacttcggacagctcggccgcctcctggtcatctagttctagttcttcttccagtttgtcctcttctctcgcaagcgattctgcttcctcttcagcttctggatccgcaagtgcatccgctagtgcttctgcttcagcttccgcaagcagcagaaatgataactccagagtaaaggcatggaagaagggaaggggtggttccgatagcctggtcctatcatccgacagttccgaggatagtaaggctagagagcttttagaaactgacgcaggtttgggtgctgccgccgcgcttgcaagagctactgccgatgcacaggcacgaactgctgctagtgctgatgctactgctaacaaagctactgctaaggcattggttttagcagaagcagctgttagggctgaaaacgcggctattgtccgtatccgtagggctttgtctgctgctcaagcactcgtctccgctagcaatcgagccaaagccgccgcaagggcagcaagagaagctgcagctaacagtgctgcagccgccgctaaagcctctaccaatcaagtcaaagcaaacgcagacagtttggtagccaacagagctgctgctgctttactggctgcagccgaagaagcactgcagaaggcttctgcgtcccagaacgcagccgcagaggctgctgcgaaagctagagccgctgctaatgcgaatgcagctactacacgagccgctgcttcggccatcttggccgaggcccgtgcacgtactgctataacgaaggcattagctgctcaatctacggcttccgcacaagcatccagcgcctctcaagtccaaaacagagctaacaatttgcaagctgagactgctagcttggctcaatcaagagccgaggccgctatcgcggcagcagccgctcaggctgcagctcttgctgaagcaaatgctcagttggcaagattgagtaaggcttcagcaggagcttctagtgagggttctgctagtgcatcggcctcagcatctgccagtgcttcatcctcctcctcttcagcaggtacgtcttc

SEQ ID NO: 2387 - DNA, 993 bp, Artificial Sequence
  Description of Artificial Sequence: Synthetic polynucleotide
gaagacttaaggtgctcgtgaagaagtggagactagagacaagactaagacatctaccgttgttaaaagtgaaaaggttgaagtagttgctcccgctaaagatgaattgaaacttacttccgaacctatctttggacgtagagtcggaaccggtgcttccgaagtagcctcgtcctctggagaggctatcgctatatctcttggagctggacagtctgctgcagaatcacaagcgttagctgcctcacagtcaaagaccgcagccaacgccgcaatcggtgcttctgaacttactaacaaggtagcagccttagtcgctggtgctactggtgctcaggctcgtgccactgctgctagctcctctgccttgaaagcttccttggctactgaagaagctgccgaggaggctgaagccgctgttgccgatgccaaagccgccgctgaaaaggctgagtcactagctaaaaacctagcttcggcctcagctagagccgctctcagttcagagagagctaatgaacttgcccaagctgaatccgcagcagctgcggaggcccaagccaagactgccgctgctgcaaaggcagccgaaattgccttaaaggtggctgagattgctgtaaaggctgaggcggatgccgcagccgctgccgtggctgctgctaaagccagagccgttgcggacgccgctgctgccagagcagcagccgttaacgctattgccaaggccgaagaggaggcttctgctcaggcagagaacgctgcaggcgtcttacaagccgctgcctccgctgctgctgaatcccgtgctgccgccgctgcagctgctgccacttctgaggcagctgctgaagcaggtccacttgctggcgagatgaagcctccgcactggaaatgggagagaattccagtcaaaaaagaggagtggaaaacttcaactaaggaggaatggaaaaccactaacgaagagtgggaagttaaaggtacgtcttc

SEQ ID NO: 2388 - DNA, 894 bp, Artificial Sequence
  Description of Artificial Sequence: Synthetic polynucleotide
gaagacttaaggtagagtcataaatcacgaatcccttaaaacgtctgaagatattcaaggtggttattctgctggaattgtaggtgatggttcggacgccctgggtagttctattgagaatgctcaaaaggtggcacgtgccgctgaaaacgtaggcttgaatcttgaactgggtgctggtgcgcgtgccgccagcgttgccgccgcggctcaggcaaagaatacggaagctgctgaagctggtgctaacgcggcgcttgctgccgccattgcaaaacgtgaagaagctattaaggcctctgagatagcgaatcagttattgactaacgcagctaaggccgccgaggctacagtaagtgcaactaaacgcgctgctcaattaactgcagctgcaaaggaggctacccgtgcctcagctgctgccgcagaggcagctactgaggcacaagttaaagctaatgctgattcgatcatcactaaacgtgcagcaatcgcagaggctcaagccgcggcagaggcccaagtgaaagccgcgatcgctagaaagtccgccgctaactttcttgctaaagcacaaattgcagcagctgctgagtccgaggcaaccaagttggctgcagaggctgtcgttgcccttacaaatgccgaggttgctgtcaatcaggcccggaatgctcaagcaaacgcgagtactcaggctagtatggccgtgagagttgactcccaggctgcaaacgcggaggccgcagcggtagctcaagccgaaactcttttggttactgctgaggcggtagccgcagccgaagctgaagtggccaacaaagctgcaacctttgccaagcagatagtaaacgaaaagaagattcatgttgccaaattagaaggtacgtcttc

SEQ ID NO: 2389 - DNA, 972 bp, Artificial Sequence
  Description of Artificial Sequence: Synthetic polynucleotide
gaagacttaaggtgtagaggagtttaaaagctctgcaactgaggaagtcatttcaaagaacttggaagtggatcttctgaagaatgttgatacatccgctaagagacgcgagaacggtgctcctgttttgggaaaaaataccctccaatctttggagaagattaagacatctgcctcagtgaacgcaaaggctgccgcagttgtgaaggcctcggcgttagctcttgctgaggcttatctgcgggcatcagccctgagcgctgctgcttcagccaaggccgctgccgctctgaaaaatgctcagcaagctcaattaaatgctcaagagaagtctttggcagccctgaaagcacaaagtgaagaagaggctgcctccgctagagccaatgctgcaacagcagccacccaaagcgccttggaaagggcacaagcttcttcccgtttggcaactgtagctcaaaacgtggccagtgatcttcagaaaagaacctctaccaaggctgctgctgaagctgcggccactttgagacaactgcaagatgccgaaagaactaagtggagtgccaacgcagctcttgaagtttctgccgctgctgctgccgctgaaaccaagaccactgccagttcggaagcagctaacgcagcagctaaaaaagctgctgctatcgcctccgatgcagatggtgcggaaagatccgcctctacagaggctcagtccgctgctaaaattgagtctgtcgccgccgcagagggtagcgctaatagtgcttctgaggactccagagctgcccagttagaggcttccaccgctgctagagcaaatgttgctgcagcagttggtgacggagctataattggactgggtgaggaggccggagctgctgctcaacttttagcacaggctaaagcattggctgaagtctctagcaaatcagagaacattgaggataagaaattctcaggtacgtcttc

SEQ ID NO: 2390 - DNA, 966 bp, Artificial Sequence
  Description of Artificial Sequence: Synthetic polynucleotide
gaagacttaaggtctggaaggaccaggaaacagtctcccagaattggtcaaaggatccgcctccgcaacagccagtaccgctgtaactgctagatctggtttgcgtgctggccaggtggcccttgcctcacaaaaagatgctgttttacaagcccaggctgcagcctcagctgcaagtgaagctcgcgccgcagccgatttgactgccaagcttagtcaggagagcgcttctgtccaatcgcaagctgcagctaagggaaaagaaaccgaagaagctgctgttggacaggctcgcgctggtcttgaatccgttagcatggctgcttccgcaacctcggccgctaaggaagctagtactgctgctaaggcggcagctagcgctttgtcaactgccgtcgtgcaagctaaaatagctgagcgagctgcgaaggctgaggcggttgcttcagatgaagcaaaggctaaggccatagctgccgccaacctcgctgcagaggcctcagttgcagcggaagccgctttaaaagctgagaaagttgctgaagaagctatcgccagagcagccagcgctaaggcagctgcacgagcagctgctgcagctttggcttctagtaaggaggctgccacagcttcagctagaaacgccgctgaaagtgaggctcgtaatgaagttgctgtattgattgcggagatcgacaaaaaatctcgtgaaatcgatgctgcttctagtttgaacgctagagcagccgctaaagcctcaagtagaaatgtcgagactgctactatcggagcaaatattaattcttcaaagcaagtggtttccatcccggttgagataaaaaaattttcagaacctgaggtttctacgtcttggagagaagatgaagaggtgaccaaggagaaaaaggagcacattaatttgaatgattttgatcttaaatctaatgtgttctcaggtacgtcttc

SEQ ID NO: 2391 - DNA, 693 bp, Artificial Sequence
  Description of Artificial Sequence: Synthetic polynucleotide
gaagacttaaggtgctaacgccaattctgactccaactccaattctaattctaatgctaactccgacgcaaacagtaactcttactccaactcgggagctaatgccaactcgaactccaattcgaattcgaatagcaacgcgaattctgatgcaaactctaactcgtattcaaacagcggtgccaatgctaattcaaattctaattcaaactcaaatagcaacgcttattccgacgccaactctaattcctattctaattcgggtgcaaacgctaattcttactctaacagtaacagtaactctaatgcaaattctgacgctaactcaaatagttactcaaatagtggtgctaacggaaacagtaattccaactctaactcaaactctaatgctaatagcgacgccaatagtaacagttacagtaattccggatccaacgccgactccaacgccaatagtgactcaaatagtaacgctaacagtgatgcaaactccaattcttatagcaatagtggagcctacgcaaattcaaacgctaattcaaattcaaatagtaacgcgaactctgacgcgaactctaattcatattcaaattcgggtgctaacgctaattcgaacagtaactccaactctaattcaaatgctaattccgacgctaactctaactcctactccaattcaggtacgtcttc

SEQ ID NO: 2392 - DNA, 723 bp, Artificial Sequence
  Description of Artificial Sequence: Synthetic polynucleotide
gaagacttaaggtgacggcagtggtagcggaagtggatcaggatcaggtagtggtagtggatctggatccggctcgggaagtggatcaggttctggtagtggaagcgattcaggatcgggatccggaagtggccatggttcctctagttcttcgtctagcggagatggatcaggtagtggttctggttccggatctggatcaggatccggttctggttccggaagtggttcaggttctggttcaggaagtggtagtggatccggtcacggatcgagttccagttcttcatcaggtgatggtagcggtagtggatccggtagtggcagcggatcaggttcaggttctggatccggctctggatccggatccggtagcgactctggttcaggctctggttcaggtcatggctcttcatcaagttcatcttcaggtgacggatctggttccggttcaggatctggatcaggttccggttcgggatctggaagtggcagcggctccggatccggatctggatccggatctggttctggacacggctcctcatctagtagctcatcaggagacggcagtggttcaggatctggcagcggcagcggatcaggaagtggttctggttcgggtagtggaagcggctcaggaagtggttcgggatccgattctggctcgggatcaggttctggtaacggctctagcagttcgagtagttcaggtacgtcttc

SEQ ID NO: 2393 - DNA, 567 bp, Artificial Sequence
  Description of Artificial Sequence: Synthetic polynucleotide
gaagacttaaggtaataatttaaatgcccaaaatatggctgcaggttctaatactcagataactgctggtaatgttataggttcagctatccagaacacagcggctggattggctgcttcagcaaacattatcaacaacggtgtaaacagaattgttactaattcaaacactaagggattagttaatactatcagcaggattaataacttgaacggaagaaacaacggagcattgggtttgaacggaaacaacttacagggccaggttcctttggtaaatggtgtgaaccaggccgtcaccaactcgaacacgcagggattggtcaacactatttcacaaatcaacaaccttaacggtggaaacaacggtgccttaggtgttaatggtaataatctgcagggtcaggttccattggtcaacggtgttaaccaggctgttactaacagtaacacccaaggtttggtcaacaccatctctcagattaacaatcttaatggaggaaacaacggcgctctgggtgtaaatggtaacaatctacagggccaagttcctttaggtacgtcttc

SEQ ID NO: 2394 - DNA, 561 bp, Artificial Sequence
  Description of Artificial Sequence: Synthetic polynucleotide
gaagacttaaggtaacaatcttaacgcccagaatatggctgctggatccaatacgcagattacggcaggaaacgtaataggcagtgccatccagaacaccgcagccggtttagctgcatctgctaatatcattaataacggcgtcaatcgaattgttactaatagcaatactaaaggtctggtgaatactatttcacggatcaataaccttaatggtaggaacaacggcgcccttggattgaacggtaacaacctacaaggacaggtccctcttgtcaacggagttaatcaagctgtgaccaacagtaatacacagggtttagtaaacactatttctcaaattaacaatttgaatggtggcaataacggagcattgggagtcaatggtaacaatttgcaaggccagttgccactcgttaacggtgtgaaccaggccgtgactaattcaaacacccagggagtggtaaacacaaatagtcaaatatcgaacctcaatggagctaacaacgttgcattgggtgttaatggaaataacttgcaagaagccctaggtacgtcttc

SEQ ID NO: 2395 - DNA, 567 bp, Artificial Sequence
  Description of Artificial Sequence: Synthetic polynucleotide
gaagacttaaggtaatagcttgaacgctcaaaacatggctgccggctctaacacacagattacagccggcaacgtaattggttccgcaatacaaaatactgctgccggactggcagcctcagctaacattatcaataacggtgtcaatagaatcgttaccaattccaatacgaagggtttggttaatacaatctctagaataaacaaccttaacggcggtaataacggtgccgttggactaaacggcaacaacctacaaggccaggttcctctggtcaatggtgtaaaccaagcagtaaccaactctaacactcaaggattagttaatactatctcccaaatcaacaacttgaacggaggaaataatggcgccctcggtgttaatggtaataatttacagggtcaagtgcctctcgtgaacggtgtgaaccaagccgttacgaattcaaacacccaaggactagttaatacaattagtcagatcaacaagttgaatggtggcaacaacggagctttgggtgtgaacgttaacaatctccaaggtcaagtccctctaggtacgtcttc

SEQ ID NO: 2396 - DNA, 1239 bp, Artificial Sequence
  Description of Artificial Sequence: Synthetic polynucleotide
gaagacttaaggtagaccatcgggagacgacgacgtccgaattatttcttcgaccaaggacgttacttctactggaaagagaagatcaaactctaagaacaatgtcgctcaatcttcctctcaaaaggacagtatccgggtaaaggactcaaatgaagtcattaaatccatctccgaaaatgatcctgacggtacgcgtattactacctcaaagggtacaggagtcggttctgaaacattgaatgaaaatttggttgagttgaatcaaaatacagtatcagacaccaactctgtcgaaacttcctccgataaatctaacagtgtgactacttacgacgctgatgatagaccgctgaccgtcaccgacagaaaaggccaaaaggatgtgaagtccgccactaatgctaaggaagatagttcggaagtgtcagaaaattctgaatctgaaaccaattggcaatcagagtctgactctgttgaaaagtcggtatcacatccagtttgcggaggagctgagtccccatcgagtggtggaccacagggatctggccctcaaggtggaggttcccaaggtggaccatcaggtcagggacaacctaacggcggcatagctgtttcaagcgctgaggacgccgccgccccacagtcaactcgtacgtcaactgcagagggtgaatcgtcgtcctttagtgctgccgcagatgttaatgaaggttctagaaagggcaatgtagctctggctggaagtaccgcttacggtcgttcggtcaccaatgaaaactcctcttctggttctacacaaagtttttcaggtgccgcagaagaaaacgtcgcttcacctgacggtggtagtacccaaagaaatgctgctatcgctggtaatattgcagagggacaagtctcttcaaaagaagaggtggccgaaggtaaggctacctctttatcaggtactatccaagaaagtgacgaaaactcacaacgtagcgccgctattgccggttcctcggccgaagctaacgttgctacacgagagcagacctctaaaggtaagacagccgcttggactggaaactctcaagaaaagtctacttcgccagcagagatttcagagactaacattttctcctctggttcctatgctgagggatctactttatcaagagaaaagttggaacagggtaaatctacaacatggtccgaagaatctgaagagtcccgtaaacacggaggtacgtcttc

SEQ ID NO: 2397 - DNA, 591 bp, Artificial Sequence
  Description of Artificial Sequence: Synthetic polynucleotide
gaagacttaaggtgcagttgccggtggtgttgctggagcttcgtcgaaggcctccggtaacgaaggtagtggtgctgcttccggtgctaaaaccgtttctgtagcaggcacggacggttccggtggtgccttggctggttcagctgccggagctatttcgaaggcttcaggtgacgaaggttcaggagcagcatccggagctaagaccgtatcggtcgctggtaccgatggcagtgaaggagccgtagccgtaggtgttgcaggagcctcgtccaaagcttccggaaacgaaggttcgggagcagcttctggcgcaaaaactgtgagtgttgccggtaccgatggttctggaggagcccatgccggctctgccgctggagcttcttcaaaagcttccggagacgagggtagcggtgctgcctccggtgcaaagacagtatccgtggctggtactgatggttcaggaggtgctcttgctggcggcgctgccggtgcttctagcgaggcgtcgggtgatgaaggatcaggcgcagcatctggagcaaaagctgtttctgtagctggaacagatggctccggaggtacgtcttc

SEQ ID NO: 2398 - DNA, 444 bp, Artificial Sequence
  Description of Artificial Sequence: Synthetic polynucleotide
gaagacttaaggttctagcggaagaggattgggtggatacgatggttcggtcgacggaggatacggttccggcagtggttccgccgctgcagcagccgccgccgctgccgcaggatcctctggtcgtggtattggtggatatgacggattcgtagatggaggatatggttcaggaagtggatcggcggcagcagcagcagctgcagctgccgcagcagcaggatccagcggaacaggtttcggcggatatgatggttttggcgacggtggatacggttctggctcaagtgccgcggcggctgctgcagctgctgccgcagccgctggttcttcaggaagaggtttgggaggatatgatggttgggtagatgacggttacggttccggatcgggatctgccgcagcagctgccgctgccgcagctgccgctgcaggtacgtcttc

SEQ ID NO: 2399 - DNA, 447 bp, Artificial Sequence
  Description of Artificial Sequence: Synthetic polynucleotide
gaagacttaaggtaataatctgcatcatcatgatgaatacgttgacaaccatggtcagttggtcgagagatttactactaggaagcattatgaacgtaatgctgctactcgtccacacctttctggaaacgaaagactcgtcgagactatcgttttagaagaggacccatacggccacgaggatatttacgaggaggacgtagttataaacagagttcccggagcttcatcatcagctgcagcagcctcctctgcttccgctggttctggacaaactattattgtggaaagacaggcaagccacggagctggaggtgcggctggtgctgccgctggagctgcggccggttcctctgccagaggtggaagtggtttttatgagactcacgattcttactcctcctacggatcgggctcatcaagcgctgccgccgcaggtacgtcttc

SEQ ID NO: 2400 - DNA, 423 bp, Artificial Sequence
  Description of Artificial Sequence: Synthetic polynucleotide
gaagacttaaggtagcggtgctggaggtgtgggtggtggatatggtggtggtgacggaggctatggatcgggctcatccgcagctgctgccgccgcagctgccgctgcggctgctagcagacgtgctggtcacgaccgtgcatacggtgcgggttccgctgccgccgctgcagctgcagccgcagctggtgcaggagcttctaggccagtaggtatctatggtaccgatgatggattcgttctggatggaggatatgactcggaaggctctgcagctgcagctgctgctgctgcagccgctgctgcatcatcatctggcagatctaccgaaggacaccctttactttcaatttgttgtcgtccatgctcacatagacatagctacgaggccagcagaatcagtgtacacggaggtacgtcttc

SEQ ID NO: 2401 - DNA, 579 bp, Artificial Sequence
  Description of Artificial Sequence: Synthetic polynucleotide
gaagacttaaggttctggagctggtagagctggtggtgattacggatggggcgacggtggttatggatcggattcggctgcagcggccgctgcggctgcagctgccgcatctggagctggcggaagcggtggcggatacggttggggcgacggtggatatggatccgattcagctgctgctgctgctgcggccgccgctgctgcatccggagcaggaggctctggaggaggatatggttggggagatggaggatacggttccgactccgccgctgcagccgcagcagcagcagcagctgctgcaggaagtggagcaggaggtagaggtgatggcggatatggaagtggctcttctgccgcagctgcagcagccgcagcggccgcagccgctgcaagacaagctggtcatgagagggccgctggtagcgctgcagctgcagcagctgccgccgcagcagctgccgcttctggtgctggaggtagcggacgtggttacggctggggtgacggcggttatggatccgactctgctgcagctgctgctgccgcagctgctgccgctgccgcaggtacgtcttc

SEQ ID NO: 2402 - DNA, 480 bp, Artificial Sequence
  Description of Artificial Sequence: Synthetic polynucleotide
gaagacttaaggttctggtgctggtggcgcaggaggtgattacggatggggagatggaggatatggaagtgattcagccgcagccgccgccgctgctgcagcagccgcatcaggtgctggaggagccggaggtggatacggatggggagacggtggttatggatctgactccgcggcagccgcagcagctgcagcagctgcagctgccggctccggcgctggaggtaggggtgatggaggttacggatcaggatctagtgcggcggctgcggccgctgcagccgctgccgctgccagaagagcaggacatgaccgtgcagcaggtagcgcagctgccgctgctgctgcagctgctgccgctgctgcatctggagctggcggttcaggaggcggatatggttggggagacggaggttacggtagtgattccgctgccgccgctgctgccgctgcggcagctgctgctgcaggtacgtcttc

SEQ ID NO: 2403 - DNA, 1062 bp, Artificial Sequence
  Description of Artificial Sequence: Synthetic polynucleotide
gaagacttaaggtagtggagcaggaggtgttggaggcggttacggatggggagatggaggttacggctccgattcagctgctgctgccgccgctgccgctgccgcagctgctgcttcaggtgccggaggtgctggaggatacggtggttatggatcggactcagctgccgcggctgctgctgcagcagccgccgcagctgcttcttcaggtgctggaggcgcgggtggaggttatggatggggagacggtggatacggttcagactctgccgctgcagcggccgccgcagcagctgcagctgcaggttctggtgctggtggaagaggtgatggaggatatggatctggtagtagtgccgcagccgctgctgcagcagcggctgcagctgccgcttctggtgcaggaggttcaggtggtggttacggctggggagatggaggatatggtagtggatctgctgctgcagctgctgcggcagccgcagccgccgcagctggatctggtgcgggcggagtcggtggaggctacggttggggagacggaggatatggtagtgactccgctgccgctgctgcggcagctgcagctgccgctgccgcatctggagcaggaggtgccggtggctacggcggatacggaagtgattccgctgcggctgcagctgcggccgctgctgccgctgctgctggttccggtgctggtggagcaggaggtggttacggatggggtgatggtggttacggttcagatagcgctgccgcagcggccgcagctgctgcggctgccgcagcttccggagctggaggacgaggtgacggaggatacggaagtggaagttctgccgctgctgctgccgcagctgccgcagcagccgctcgacgtgcaggctatgatagggccgcaggaagtgccgccgctgcagctgctgcagctgcagccgccgccgctagtggtgctggcggttcaggcggaggatatggctggggagatggtggctacggatctgattcagctgcagctgctgccgcagccgccgcagccgctgcggcaggtacgtcttc

SEQ ID NO: 2404 - DNA, 774 bp, Artificial Sequence
  Description of Artificial Sequence: Synthetic polynucleotide
gaagacttaaggttccggtgctggaggtgtgggaggaggttacggctggggagacggtggctacggatctgattcagcggccgctgctgcagccgccgcagcagccgctagtggtgctggaggtagcggcggttatggtggttatggttcagactcagccgctgccgcagcagccgccgctgctgctgctgccgctggtagtggagctggtggtgttggaggaggttatggttggggtgatggcggatatggatctgatagtgcagctgccgcagccgccgcggcagctgcagcttcaggagctggtggttctggaggatatggaggatatggtagtgactccgctgccgccgccgctgctgcagctgctgcagcagcggctggatcaggcgctggtggagttggtggaggttacggttggggtgatggtggttacggcggatacggatcagattctgctgctgcagccgcagcggctgccgctgctgctggttccggtgcgggaggtgttggtggaggctatggcagaggagactctggttacggctccggctcttccgcagcagctgctgccgctgctgccgctgcggccagaagagcaggacatggtagatcctcaggctcagctgccgccgcagccgcagctgctgcagctgcagcagcttcaggagcaggcggttcaggtggtggatatggctgggattatggatcttatggctcggactcggccgccgccgcagctgctgctgcggctgcagctgcaggtacgtcttc

SEQ ID NO: 2405 - DNA, 522 bp, Artificial Sequence
  Description of Artificial Sequence: Synthetic polynucleotide
gaagacttaaggtaaaaaccttagacatcatgatgagtacgtcgataaccacggtcaattggttgagagattcacgacaagaaaacatttcgaacgtaacgcagcaactagacctcacttgtccggtaatgagagactagttgaaaccattgttttggaagaagatccatatggacacgaagatatttatgaggaagatgtcgttatcaaaagagttccaggtgcctcaagttcagctgccgctgcttctagcgcttctgctggatcgggtcaaactattatcgtagaacgccaggcatctcatggagcgggtggtgctgctggagctgcagctggtgctgccgctggttcatccgcaaggaggggaggtggtttttacgagactcacaattcttactcctcttacggttctggttcatcatccgctgctgcaggatcaggagcgggaggtgtcggcggtggttatggtagtgacagtgctgccgccgccgctgctgctgcagctgctgcaggtacgtcttc

SEQ ID NO: 2406 - DNA, 423 bp, Artificial Sequence
  Description of Artificial Sequence: Synthetic polynucleotide
gaagacttaaggttctggcgctggaggatctggaggtggttatggttggggagacggaggttacggaagtggatcctcggctgccgctgccgccgctgcagctgcagccgcaggatctagaagatccggtcacgatagggcctacggagctggatccgccgcagccgcagcagcagccgctgctgccggtgcaggagcatcaagacaagtgggtatttacggaaccgacgacggtttcgtccttgatggaggatatgattctgagggatctgctgctgcggccgcagcagctgctgcagcagccgcttcgagttctggtcgttcaaccgagggacatccattgctgagtatctgttgccgaccatgttcccattcacactcatatgaagcatcaaggatctctgtgcatggaggtacgtcttc

SEQ ID NO: 2407 - DNA, 579 bp, Artificial Sequence
  Description of Artificial Sequence: Synthetic polynucleotide
gaagacttaaggttcaggagctggaggcgcaggcggtggatacggatggggtgattcaggttatggatctgactcagcagccgcagctgcagcagcggccgcagccgctgccgcctcaggtgctggtggatccggaggctatggtggatatggttccgactcagctgccgccgctgcagcagcggcagcagccgcagccgcaggcgcgggagcgggcggagctggaggatcctacggctggggagatggcggatatggatcggattcggcagccgcagcagctgcagcagcagcagccgcagcaggttctggtgcaggaggaagaggtgatggtggttatggatcaggtagttcagctgctgcagcagctgccgctgccgccgcctctgccgccaggcgcgctggacacgatagcgcagccggctctgctgctgctgcggccgctgcagcagctgcagctgccgcttctggtgccggtggttctggtggtggatatggttggggagacggaggatacggttccgactcggcggcagcggcagctgcagcagctgctgctgccgctgcaggtacgtcttc

SEQ ID NO: 2408 - DNA, 579 bp, Artificial Sequence
  Description of Artificial Sequence: Synthetic polynucleotide
gaagacttaaggtagtggagccggaggtgccggaggaggttatggctggggtgatggtggatatggttcagacagtgcagctgccgcagccgcagccgctgccgctgctgctgcttccggagctagaggtagcggaggttacggtggttacggatcggatagcgctgctgctgctgcagctgcagcagcagcagcagccgctggaagtggtgctggtggtgttggaggtggttatggttggggagatggtggttacggatctgatagtgcagctgccgctgcagcagccgccgccgctgcggccggaagcggtgccggcggaaggggtgacggaggatacggttccggatctagtgctgcagcagccgctgcagctgctgctgctgccgcgagaagagctggtcatgaccgggccgcaggttcagcagctgctgccgcggctgcagcagctgccgccgcagcttctggcgctggtggatcaggtggtggatatggatggggagatggaggatacggtagcgattctgcagctgctgcggcggctgctgctgctgcggctgcagcagcaggtacgtcttc

SEQ ID NO: 2409 - DNA, 768 bp, Artificial Sequence
  Description of Artificial Sequence: Synthetic polynucleotide
gaagacttaaggtagcggtgctggtggacgcggcgacggaggttacggttggggagatggtggatatggttcagattctggtgcagctgctgccgctgcagctgccgctgcggcagctgcatctggtgcaggcggaagaggtgatggaggttatggtagaggtgacggaggatatggaagtgatagtgctgctgcagcagcagccgcagcagcagccgcggcaggatctggagcaggaggtcaggcaacggttgttatggacggtgctatggccgcaatggttttaactagagcccaacaacaattagcggctgcagccgcagctgcttcagccagtggagctggtggatctggcggaagttatgaatgggattacggaagttacggatcagattccgcagccgcagcagcggctgccgccgctgccgctgctgccggttctggtgctggcggtgtgggtggtggatatggtcgtggtgatggtggctatggctctgatagtgctgccgcagccgcagctgcagccgccgcggcagcaggatccggtgctggaggaagaggagatggtggttatggatggggagatggcggctacggctctgattctggtgctgcagcagctgcagcagcagctgctgctgctgcagccagcggtgcgggaggcagaggcgacggtggttacggatggggagacggaggatacggatccgaccctggagctgccgctgctgctgcagctgctgctgccgccgctgcaggtacgtcttc

SEQ ID NO: 2410 - DNA, 399 bp, Artificial Sequence
  Description of Artificial Sequence: Synthetic polynucleotide
gaagacttaaggtaagacacttaaccatattggactacatcctaaaggcaacacgcgtattgatgagtatgtggataaaacaggtcagctgtatgaaagatacacgaccagagaagagttcgaaaggaacgccgctactttaccacacttgtcccgcaacgaaagattgttggaaacgatcatcatcgaggaagatccatcaggtcatgagaaaatatataaagaggatgtcgttcttaaacgtgttcctggagcttcttctgccgcttctgctagtagcgctgccgccgctggttctggttccagaagattaggcaggttgcatggatgggatggcggtgcttacggctccgattcagctgctgcggctgccgctgcagctgccgcaggtacgtcttc

SEQ ID NO: 2411 - DNA, 633 bp, Artificial Sequence
  Description of Artificial Sequence: Synthetic polynucleotide
gaagacttaaggttccggagctggtggcttaggcggtctgtacggattacacggaggatattacggatcagactctgcagcagctgccgcagccgctgccgctgcagcagccggatccggagctggtggtcttggaggactctacggtttgcatggaggagtttatggttccgacagcgctgctgctgctgctgcagccgccgccgcaacagctggttctggtgcggaaggattaggaggtctgtacggactccacggaggatattatggtagtgactctggagctgcagcggccgctgcagctgcagcagctgctggtagtggtgctggtggtttgggaggacattatggactgcacggaggcgtgtatggttctgacagtgcagctgctgcggccgcagccgcggccgcagctgcaggttccggtgctggtggtttaggaggattgtatggtctacacggaggagtttatggatcctccagttcgcgtagagactcttcttccgctagctctgctgccgccgccgctgcggctgccgcaggaagctccgccgcatctagcgaaagagtctacgaatccgagtcagcagcagcagcagctgccgcggcagcggcagctgcaggtacgtcttc

SEQ ID NO: 2412 - DNA, 735 bp, Artificial Sequence
  Description of Artificial Sequence: Synthetic polynucleotide
gaagacttaaggtagcggctcaagaggtctgggtggactctacggttgggatggtggagtctacggttccgacagcgccgccgcggcggccgctgccgccgctgctgccgctggatctggtgtttctggtttaggtggtttgtacggatgggatggtggagtgtacggtagtgattccgcagctgcagccgctgcagcagccgccgcagctgccggttccggatctcgtggcttgggaggattatacggatggaatggtggtgtctatggatcagattctgccgcagccgcggctgcagctgccgctgcagcggcaggttctggcgtctctggacttggtggactttatggatgggataggggagtgtacggttctgacagcgctgctgcggctgctgccgcagctgccgccgctgccggctcaggttcaagaggattaggtggattatacggttggaacggtggcgtctatggatccgattctgctgctgccgctgccgccgccgcagcggctgctgcaggctctggtgttagcggattgggaggtctgtatggatgggacggtggtttatacggtagcgattcggctgccgcagccgctgcagccgctgctgcagctgcaggtagtggagtatcaggactaggaggcttgtacggatgggacggcggtttatacggaagtgatagtgcagccgcagcagctgctgctgcagcagcagcagcaggtacgtcttc

SEQ ID NO: 2413 - DNA, 735 bp, Artificial Sequence
  Description of Artificial Sequence: Synthetic polynucleotide
gaagacttaaggttctggagctggaggtctaggaggtctatacggttatcatggtggtgtctatggatcagatagtgctgccgctgccgcggccgccgcagcagctgccgctggttcaggtatttcaggattgggtggtctttacggatgggatggaggcctctatggttcggatagcgctgccgccgctgctgctgccgcggcagccgcagcaggttctggctctagaggattaggtggcctatacggatgggatggtggcgtgtacggatctgatagtgccgctgcagcggccgctgctgcggcagctgccgctggatccggatctcgtggactgggtggcctctatggttgggacggaggagtttatggatccgattctgcggcggcagccgctgcagcggctgctgctgcagcaggatcgggagtctctggactcggtggcctttatggatgggatggaggactgtatggatccgattcctcggccgcagctgcagcggcagctgccgccgctgccggttcaggctctaggagattgggcggattgtatggatgggatggtggagtttacggctctgattctgcagctgcagctgctgctgctgccgcagcagctgcaggttccggtgtaggtggactgggaggattatacggttgggatggaggagtttatggtagcgattctgctgcagctgccgcggcagcagccgccgctgccgcaggtacgtcttc

SEQ ID NO: 2414 - DNA, 429 bp, Artificial Sequence
  Description of Artificial Sequence: Synthetic polynucleotide
gaagacttaaggtcaatacattgacgatgacatttaccgtctgaagcgtacttacggcgaaacttctaatactcgttccgatgaatacgacgttgacaagttcggaagattatatgagcgaacaaccactcgtaagaagttcgaaggtaactcaaaagtatctccttacattagtggagatgagaaggttgtggaaactattgtttatgaaaacaacccagtcggtcgaggaactatctatgaagaggacgtcgttatcaaaaaggtacctgacgaaacgtctattggaacagctgcttcttcagcatctgctggtgctggactcggcatagctccaacaatcatcgttgaacgtcctttcgaaaattacggtggcggtgctgctgccggtgcagccgctgcagctgccgcagcagcaggtacgtcttc

SEQ ID NO: 2415 - DNA, 573 bp, Artificial Sequence
  Description of Artificial Sequence: Synthetic polynucleotide
gaagacttaaggttcgtctggtgttggttacgaaaggggatacggttctgactctgctgctgcggcagccgctgctgcagcggccgccgcggctggatctggatctagaggtcttggaggttactacggagatggattgttggatggaggctacggtagtggatccgccgctgccgcggccgccgcagctgctgcagctgctgattccggtagtagaggtttaggcggatattatggagacggcctgctagacggagaatatggatcaggctcagctgcagccgctgccgctgccgctgctgccgctgcaggatcgtcaggagtaggttatggtcgtcgttatggaagcgattctgctgccgctgctgcagcagctgctgctgcagcagcaggttcatcaagcgactacacagtgtatgaaagctctagacggggatccagctcttcagccgcagccgcagccgccgccgccgcagccgcaggttcaagcgaagctggttacgaaagaggttacgaatcggattcagctgctgcggcggctgccgccgcagcagctgccgcaggtacgtcttc

SEQ ID NO: 2416 - DNA, 807 bp, Artificial Sequence
  Description of Artificial Sequence: Synthetic polynucleotide
gaagacttaaggttccggaactaggggattgggtggatactacggtaaagatggtggtttattgttagatggagagtatggttccggatcagccgctgctgctgccgctgctgccgccgccgcttctggaagccgtggcttgggtggtttttatggcgacggacttctggatggaggctatggttctggctctgccgccgctgccgccgcagcagccgctgctgcaggatcaggaagtagaggattaggaggtttttatggtgacggactcttggacggaggatatggttctggttctgcggcggcggcagctgcggctgctgcagccgcaggcagtggatctcggggattgggtggctactatggcgacggaatattggatgacggttacggttctggttcggctgccgctgccgctgcagctgcagcagccgctgccggatctggctcaagaggacttggtggctattacggagacggacttttggacggtgagtatggttctggtagcgccgcagccgctgccgcagctgcagctgcagccgcaggatcgtccggagttggatatggacgtagatatggttctgattccgcagcggctgcagcagcagccgcagcagctgccgccggttcttcgtctgactacactgtttacgaatcttcacgaagaggatcatcatcttccgcagcagctgctgcagcagcagctgctgctgctggtagttccgaagctggttatgaacgtggatatgaatctgatagtgctgcggctgcggcagctgcagcagctgccgcaggtacgtcttc

SEQ ID NO: 2417 - DNA, 588 bp, Artificial Sequence
  Description of Artificial Sequence: Synthetic polynucleotide
gaagacttaaggttccggaagtagaggcctgggcggtttctatggcgacggattactggatggaggatatggcagtggttctgctgcagcagctgctgcagctgccgctgcagctggtagcggctccagaggtctgggaggttattatggagacggtttacttgatggcggctacggatcaggatcggctgccgccgctgctgcggctgctgctgctgcaggatcaggttctagaggattgggtggctattacggagacggattgttggatggtgagtacggatccggttcagctgccgcagctgcggccgctgcagctgctgctgagggatcatcaggcgttggatatggtagacgttacggtagcgattctgctgctgccgctgcagcagccgctgccgctgccgcaggatcctcctccgattatactgtgtacgaatctagtagacgtagaagttcaagtagtgcagcagcagccgcagcagctgcggctgcagcaggatcttccgaggcaggttacgagagaggctatgagtctgattctgctgccgcagccgccgctgctgccgcagctgcaggtacgtcttc

SEQ ID NO: 2418 - DNA, 684 bp, Artificial Sequence
  Description of Artificial Sequence: Synthetic polynucleotide
gaagacttaaggttctggttcaagaggacttggcggattctatggtgacggtttgcttgatggaggttatggttctggttccgctgctgcggctgccgctgctgcagcggctgctggctccggatccagaggattaggaggttattacggtgacggtttattagacggtggatatggatctggttcagcagcagcggcggctgccgccgcagccgcagccggttctggcagtcgtggccttggaggatactatggagatggtctattggatggtggatacggctctggaagtgctgcagctgcagccgctgcagctgcagctgccggttctggaagtggtggcttaggtggctactacggtgatggtctgttggacggagaatacggatcgggttcggctgcagctgcagcagcagcggctgctgctgccgagggctcatcgggtgtaggatatggcagaaggtatggttctgactcagcagctgctgctgctgcggccgcagctgctgcaggatcctccagtgactattctgtctataaatcatccagaagagaaagttcctccagtgcagccgccgcggctgctgcggctgcagccgccggctcatccgaagcaggctacgaaagaggatacgagtccgactctgccgcagcagctgcagctgctgcagcaggtacgtcttc

SEQ ID NO: 2419 - DNA, 639 bp, Artificial Sequence
  Description of Artificial Sequence: Synthetic polynucleotide
gaagacttaaggtgatgctattgatgacagtctattaaatttcaataatgaaaacttcattgaaatcggtgagtcgactaccgctgaagttgatgtagaaaacggcactctagtagaaagggaaaccacccgtaaaaaatacgaacgtgacggtgatataacccctaatatctcaggtgaagataaaatcgtgagaacttttgtcatagaaacagatgcttctggtcatgaaactgtctacgaggaggacgtcgtcattaaacgtaagccaggccagcaaggtgtgactgagcgtacaactataggccgtagacaaactggtataagtgccgcaccagtgcctgcccctagttcccaggctccaaccgtcgttgttgaatccaattcacctatcgcgccagcgccagttagtggacctgtttccatcggtcctcaattgggcgccgttggcccttacggtccatcaagaagctcaaccgcaacaaccacctctggtaccggtgttgttcagcaaatccgtactgacagcactggttcatcagcggcttcagctgctaccggcgcttcttccgtagctccagttattgttatcgaggacggtagcagcgccgcgtctgctgcagctgcaggtacgtcttc

SEQ ID NO: 2420 - DNA, 327 bp, Artificial Sequence
  Description of Artificial Sequence: Synthetic polynucleotide
gaagacttaaggttctggagcatccggtccaggaggactgggtctgggcggcttaggcccgtatggcggaattggccctaacgtggtgtccgcagcaagcgcccctgtcgttggaccttctgtgagctcagtcggacctgttggagcccaggtgatcgagatcggttctccagttgtgccatccgtgagcagaactggcagtgtttctagagtttcagtctctggtagacctggagtcagagtcccgtgtagtcttacaagaaggcaatttgtcgtcaaaattggtactaggagacaaccatgtggttattgctcaggtacgtcttc

SEQ ID NO: 2421 - DNA, 1461 bp, Artificial Sequence
  Description of Artificial Sequence: Synthetic polynucleotide
gaagacttaaggttcaggtgcaagtggtgtgggcggattgggactgggtgcattgggtcctttaggtggtattggtcaatcaggagtctcttcagctaccacgtcgggagcaggcctaggtggtgtgggagccgtgggagcctcgggtttaggtggtcttggtggagctggagcttctgctgctggatccgctggagctggactcggtggagtaggagtgggtggatcctcaggatcatctgctgcatctgccgcatctggcgctagcggtgcaggcgaggttatattaattgatgatcgttcttctgctgcttccagggcagctgctggttccggagcttccggtgtgggaggtttgggtttgtcaggattgggtccaatcggaggtattggaccaattggtgccacaagtgcctctacttctggtgccggtcttggtggtgtcggagctgctggcgcctctggcttgggaggtctaggaggcgctggtgcaagtgccgctggttctgcgggtgctggattaggaggtattggagcaggaggatcatcaggctcgtcagctgcatccgcagcatccggtgcctctggtgctggtgaagtaattgtgatcgacgatagatcatcggccgcatccgctgccgcagcatcttctggagcatcaggtctgggtggtctaggacttggaggactcggaccttatggtggtataggtttaaatggtgtttctagcgcatccgctctaggcgctggacttggcggagttggaactgcaggagcttctggcctgggtggtttaggaggagcaggagttagtgcagttggacctgccggtgcaggcctgggaggcgttggtgccggaggatcgtcaggatcttcagcagcctctgcagcctccgccagaagtggtccagcgccagttatcgttattgaggacggtagttctgccgcatctgctgcagctgctggtagtggagcatcgggcttaggtggtctaggcctcggagcgtggggacctttgggtggtataggacctaacgaggtttcttccgcttccgctactggaagtgcagctggatccactggtgcaggtttgggaggttccggtgcagctggtagtagtgctgccagtgctgctagtggcgctgctggtccagctccagtaatagtgatcgaagatggatcctctgcagcttccgcagctgccgctggaagtggtgcatcaggcctgggcggtcttggtttaggcgctatgggaactcttggtggtattggaccgaatggtgtgtctagcgcttccgccacgggttcagccgcaggatctatcggcagcggactttgcggcagtggtgcggcaggttccagcctggcttcagcggcttccggtgctgctggagcagcaccagtcattgtcatagaggatggatcatcagctgcctctgccgcagctgcaggtacgtcttc

SEQ ID NO: 2422 - DNA, 1704 bp, Artificial Sequence
  Description of Artificial Sequence: Synthetic polynucleotide
gaagacttaaggttctggagcatccggtgtcggtggattgggtttgggagctttaggtccactgggtggaataggtcctatcggtgcctcttccgctggtgcttccggagctggattgggtggtgttggagcagctggaacatctggccttggtggtatcggtggagtcggagcttcaaccgctggatccgctggcgctggtttgggaggtataggagccggtggttcgtcgggatccagcgctgcgtccgccgcatccggagctagtggtgccggtgaagttatagttattgatgacagatccagtgccgcatcggcagctgcagctggctctggtgctagtggccccggaggcctcggattgggagtctggggtcctttaggtggtataggaccaattggagcttcatccgcatctgcaagcggagctggtttaggtggagtgggagccgccggcacttccggtttaggcggattgggcggtgctggtgcatctgcggctggatctgctggtgctggtttgggtggtattggagcaagtggttcctcaggatcaagtgtcgcttcagctgccagtggtacttcaggagccggagaggtgatcgtaattgacgatagaagctcggctgcttcagccgctgcagctggctcaggagcgtctggacttggcggtctaggtctgggtggactcggtccatatggtggaattggtctaaacggagtgtcgtctgcttccgctctaggcgctggattgggtggagtcggtacggcgggagcttctggcttaggtggacttggaggaaccggcgcctcggcagctggtagtgccggtgctggcttaggaggcgttggtgctggaggttcttttggttctagtgcagcctccgctgctagtggagcatcgggtgctggtgaagtgattgtaatagacgatagatcttcagccgcaagtgctgctgcagctggttccggcgccagcggtccaggcggcttgggtttgggtgtctggggacctctaggcggtatcggtccaaacggtgttagttccgccagtgccactggttcggccgccggatccaccggagctggtctaggaggatctggtgcagcaggttcaagcgctgccagtgctgcctcaggagctgccggaccagctcctgtcattgttatagaggatggttcaagtgccgcctcggcagctgctgctggttccggtgcaagtggtctaggtggattgggtctgggagcctggggtcctcttggtggaattggacctaatggagtctcctctgcttcagcaacgggatctgccgccggatcaactggtgccggtttgggtggctcaggagcggctggttccagcgccgcttcggcagcatctggagccgcaggacctgctcctgtgatagtcatcgaagatggttcctcagcagctagtgctgcggccgccggttcaggtgccagcggtctaggaggcttgggactaggtgcatggggacctttaggaggaatcggacctaatggtgtttcatcagcttcagctacaggatctgccgccggcagtactggagctggtctgggtggttcaggagctgcaggctcctcggcggcatcagccgcttctggagccgcaggtcctgctccggtgattgttatagaagatggttcatctgcagcctccgcagccgcagcaggtacgtcttc

SEQ ID NO: 2423 - DNA, 414 bp, Artificial Sequence
  Description of Artificial Sequence: Synthetic polynucleotide
gaagacttaaggtaatattaatgatttcgatgaggattacttcggttccgacgttaccgtccaaagttcaaatactacggatgaaatcatcagagacgcatctggagccgtaatcgaggaacagataaccacaaaaaaaatgcaacgtaagaacaaaaatcacggtatccttggcaaaaatgagaagatgataaaaacttttgttattaccaccgactcggacggtaacgaaagtattgttgaagaggacgtgcttatgaaaacattgtccgatggtactgtggcccagtcatacgttgccgctgacgcaggagcctattcgcagtccggaccttatgtcagcaactccggttactcaacacatcaaggttacacttctgatttcagtacctccgctgctgtaggtacgtcttc

SEQ ID NO: 2424 - DNA, 471 bp, Artificial Sequence
  Description of Artificial Sequence: Synthetic polynucleotide
gaagacttaaggtgctggtgctggctccggtgctgcttccggagctggtgccggtgctggtgctggtacaggctcatcaggatttggaccatatgttgctaacggaggatactcccgaagagaaggttacgaatatgcatggtcctctaaatctgacttcgagactggttccggtgccgccagtggagcaggagcgggcgccggtagcggtgcaggagctggatctggcgctggtgcaggctctggagccggcgcaggttccggcgcaggcgccggtggtagcgtgagctacggtgctggtagaggttacggtcagggcgcaggctctgcagcctcttctgtgtcatctgcatcgtctagatcatatgattattcccgcagaaacgtcagaaaaaattgcggaatccctagacgccaattagtggttaagtttcgagccttgccatgtgttaattgcggaggtacgtcttc

SEQ ID NO: 2425 - DNA, 1230 bp, Artificial Sequence
  Description of Artificial Sequence: Synthetic polynucleotide
gaagacttaaggtgcaggagccggttcgggtgcaggagcaggttccggagccggcgcaggttctggagcaggagcaggttcgggtgctggctacggtgcgggagtgggagcaggctacggtgctggttacggtgctggtgctggagctggttatggtgctggtgctggctctggcgctggtagtggcgcaggcgccggatctggtgcgggcgcaggttcaggtgccggtgctggatccggtgcaggagcaggatccggtgctggtgccggctctggtgctggtgctggtagcggtgccggagcaggatcaggagccggtgcaggatcgggagcaggagctggatacggagcaggctacggcgcaggagctggagctggatatggagccggagctggcagtggtgcaggttcgggagctggcgcaggttctggtgccggtgccggttctggtgctggagccggttctggagctggagcaggttcaggagctggagctggttctggtgcaggcgcaggctccggtgcgggtgccggctctggagccggagccggatacggtgctggagttggagcaggttacggtgccggttatggagcaggagccggagccggttacggagctggtgctggttcaggtgctggatccggtgccggtgctggttctggagctggtgccggttccggagctggagccggctcaggtgctggtgttggatcgggagccggtgctggctccggagcaggagctggttccggtgccggagcaggtagcggcgccggagcaggatacggtgcaggatatggtgccggcgctggtgccggatatggcgctggtgcaggatccggagcaggctcgggtgctggagctggatccggagccggtgccggaagcggcgctggcgccggttctggagccggcgctggaagcggagctggtgccggatctggagctggtgctggaagtggtgctggtgcaggttctggtgccggagttggttacggagcaggagttggcgccggatacggtgctggctacggcgctggcgccggagctggttacggagctggcgcaggatcaggagcagcatcaggtgctggtgccggtgctggagctggtgcaggtacaggttcctctggttttggtccttacgtcgctaacggaggatactccggatatgaatacgcttggagttctgaatcggattttggcacgggctcaggtacgtcttc

SEQ ID NO: 2426 - DNA, 978 bp, Artificial Sequence
  Description of Artificial Sequence: Synthetic polynucleotide
gaagacttaaggtgctggagctggttctggagctggagctggtgcaggagctggcgctggaagcggagctggagctggttatggagctggtgtcggagcaggttacggagctggatacggagctggtgccggcgccggttacggtgctggagccggatctggcacgggttccggtgctggagcaggatctggtgctggtgccggatacggcgctggcgttggagctggatacggcgcaggcgcaggaagtggtgctgcttttggtgctggtgcgggcgcaggcgcaggttccggagccggtgccggctcaggtgctggtgctggttccggagccggagcaggcagtggtgccggcgcaggatctggtgcaggagctggatatggtgccggttatggtgccggagttggtgcaggatacggagccggtgccggtagtggtgcagcttctggcgctggcgcgggatctggtgctggagctggaagcggcgcaggagctggttctggtgctggtgcaggatcaggagcaggagctggatctggagctggtgcgggctacggagccggagttggtgctggttatggtgctggttacggagctggcgctggagcaggatacggtgccggtgccggctccggagcagcttcaggtgcaggcgctggttcaggagccggcgcaggagcaggatcaggagcgggcgctggatccggcgctggcgccggttccggtgcaggcgccggaagcggagcaggttccggtgccggcgctggttcgggagctggtgccggatctggagccggtgctggatatggtgctggtgccggttcgggtgcagcttctggtgccggagccggagccggtgctggagccggtacaggttcttccggtttcggaccttacgttgcaaatggaggatactccggatacgagtacgcgtggtcctcagaatccgattttggaactggttcaggtacgtcttc

SEQ ID NO: 2427 - DNA, 1194 bp, Artificial Sequence
  Description of Artificial Sequence: Synthetic polynucleotide
gaagacttaaggtgccggtgcaggatcgggagctggcgctggatctggtgcaggagccggatatggagccggttatggtgccggagttggagcaggttacggtgccggtgcgggcgtaggatatggtgccggagctggtgcaggatacggagctggagctggctcgggtgctgcaagcggagctggagccggtgccggtgctggtgcaggatccggagctggagcgggttctggtgctggtgctggcgcaggctcaggtgctggtgccggatatggagcgggatacggaattggtgtgggagctggctacggtgccggtgctggagtcggttatggtgctggcgcgggagctggatatggcgcaggagccggttccggagccgcttcaggtgccggtgccggtagcggtgcaggcgctggatcaggagccggtgctggctctggagccggtgcaggttctggagccggtgccggaagtggagccggtgccggatcaggcgccggtgctggatacggagctggatatggagctggtgtgggcgcaggttacggagctggtgctggtgttggttacggtgctggtgccggtgcaggatatggtgctggagcaggttccggcgctgcttcaggtgctggagctggtgctggagccggtgctggagctggttcaggcgcaggagctggatcaggagccggcgccggatcaggagctggtgctggttctggtgctggagctggaagcggagccggcgctggttctggagctggagctggatctggtgcgggcgcaggatcgggtgccggagcaggctcaggagctggcgccggatacggagctggtgtcggtgctggttacggagctggttatggcggtgcgggtgcaggttatggagctggagcaggttctggagctgcttctggtgctggtgcgggctcaggagctggagctggatccggagccggtgctggatctggcgccggtgcgggatcaggtgcgggtgctggaagtggcgcaggcgctggctatggagctggcgccggcagtggtgccgcttctggtgcaggcgctggagccggagcaggcgcaggtacaggttcttctggtttcggtccatacgttaacggtggatattccggatatgaatacgcgtggtcatcggaatctgactttggaactggatcaggtacgtcttc

SEQ ID NO: 2428 - DNA, 528 bp, Artificial Sequence
  Description of Artificial Sequence: Synthetic polynucleotide
gaagacttaaggtgcagatattttggaaactggtattcttggaggcaatgtccgcgaggtttctgaatcgactactgataattttaccactgatggtaatggtaacgtgaccgaagtaaaaacaacacataaagaattccgcagacaaggtgaggttcctaacaatatttcaggagaggacaaactcgtcagaacttttgtaatcgaaaccgacgcatcgggaaacgaggtcatatacgaggaggatgtagttatccataaggttcctggtactagtgcaactacaaagactactaccgctagaaggcaacttggtggtatcggtggtacaggagcagcctcctcttctgccgcaactagtcctcctcggcctactagtccatatggtccaaatggttcctctagtgcagctacttcttctgcttccggttccgccccagttattgtcattgaagagaatcagagctcggctgccgccgctgcttcttcttccagctccggaccaaatggactcctaggtacgtcttc

SEQ ID NO: 2429 - DNA, 591 bp, Artificial Sequence
  Description of Artificial Sequence: Synthetic polynucleotide
gaagacttaaggtccatacggaccaaatggttcgagtgcttcaagcgcagcttcttccggagctgcaggagctggtggccttaacggaatatacggtagtaacggtgctttgttgagcggcgctgcaggcgtcaacggtttaaacggtctttacggcccaaacggcagttctgcttcttctgcaggagccgcaggaattggtggtctaaatggattaaacggttcaaacggatcttcctcggccgctagttcttcagcttctggctctggaccagtaatcgtgatcgaggaaaaccaatcttctgctgccgctgccgcctcctcttctagttcgggaccaaacggtttgttgggtccttacggtcctaatggatctgcggcttcaagtgccgcagcaagtaatgcaggaaataacggtcctgtagttattatagagaggggatcctcttcatccgcagctgcgggttcatcatcatctgccccttacgtccttccaggtgtccgtggaccttgtcgactaaccaggagacagttcgtagtgaagataggatctagacgacaaccttgtcttacttgttcaggtacgtcttc

SEQ ID NO: 2430 - DNA, 705 bp, Artificial Sequence
  Description of Artificial Sequence: Synthetic polynucleotide
gaagacttaaggtccatacggtccaaatggttctgctgcatcgtcagcagctgcaagtggagccgctggagccggtggcctaaatggattatatggatccaatggcgccttattgtccggagctgcaggagtcaatggtttgaatggtttgtatggacctaatggttcatcggcttcatccgctggtgccgccggcattggcggtttaaacggtttgaacggcagtaatggatcagcatctgccgcatcatcctcagctagcggtagtggacctgtcattgtaattgaggagaaccagtcgtccgccgcagcagccgcctcttcatcaagttcaggacaaaatggcttgcttggaccgtacggtcctaacggaagttctgcttcctctgcagcctcctctggtgctgccggcgccggtggtcttaatggtatttatggatctaacggtgctttgctctcaggtgctgcaggagcaaacggcgttaacggtctgtatggtccaaacggatccagcgcatcttccgccggtgctgcaggaatcggcggactcaatggcctaaatggttcaaacggttccgcttctgcagcttcatctagcgcttctggaagcggacctgtaattgttattgaagagaatcaatccagcgccgctgctgcagctagttcctcctcttctggccctaacggattgctaggtacgtcttc

SEQ ID NO: 2431 - DNA, 705 bp, Artificial Sequence
  Description of Artificial Sequence: Synthetic polynucleotide
gaagacttaaggtccttatggacctaacggtagtgcagcttctagtgccgccgcctcaggcgctgccggtgctggaggtctgaatggtctttatggttccaacggtgcattgctgtccggtgctgccggagttaatggcttgaacggcctatatggacctaatggttcgtctgcgtcctcagcaggcgctgcaggaatcggaggattaaatggtctgaacggttcgaacggatcagcttctgctgcctccagttccgcatctggaagtggaccggtaattgtaatagaagaaaatcaatcttcagctgctgctgccgcgtcatcatcttccagtggccagaatggcttgttaggcccatatggcccaaacggaagcagtgcatcctctgcagcaagttctggagctgctggagctggtggtttaaacggaatttacggctctaatggtgctttgctttctggtgctgccggtgcaaacggtgtaaatggcttgtacggaccaaacggatcaagtgccagctcagctggcgctgccggtatcggtggtttgaacggacttaatggatcaaatggatcagcatcagccgcctcctcgtccgcgtctggatcaggtccagtcatagtaattgaagaaaaccaatcttccgctgccgctgcagcttcttcaagtagttccggtccgaatggcttactaggtacgtcttc

SEQ ID NO: 2432 - DNA, 945 bp, Artificial Sequence
  Description of Artificial Sequence: Synthetic polynucleotide
gaagacttaaggttacggttcgggttcttccgccgcagcagccgctgctgcagcagccgccgcttccagaagagcaggccacgaaagagctgccggttccgctgctgctgctgcagccgcggctgccgctgctgcctccggtgtgggtagaagtggtggctcatatggttggggtgatggaggctacggatcagactctgccgctgctgctgctgccgcagctgctgcagctgctgctgcttctggagcaggaggagcaggagtatgtagaggttatggtggttacggatctgacggaagtggaagtgcagccgctgcagctgcagctgcggctgctgctggtagtggcgcaggaggcgttggaggaggttatggttggggagacggagcttatggttctgattcagccgccgccgcagcagctgcagccgcagccgccgctggttcaggtgccggtggtagacgcggatacggagcctacggatccgacagcagcgccgcagccgcggcagctgcagctgccgcatccggtgctggtggttctggtggtggttatggatggggagatggtggatacggatccgactcggctgcagcagcagctgctgcagccgctgctgccgctgctgctggttcaggagccggaggtataggtggaggattcggaagaggtgatggaggatacggttctggaagttcagcagcagcagcggctgctgctgcggctgccgctgcgagacgtgctggtcatggaaggtctgctggtagcgcggcagcagctgctgccgcggcagcggccgctgctgctagcggagctggaggatccggaggttcttacggttgggattatgagtcatatggtagcggttctgctgctgcggccgccggttcaggcgcgggaggatctggaggtggttatggttggggtgacggaggtacgtcttc

SEQ ID NO: 2433 - DNA, 297 bp, Artificial Sequence
  Description of Artificial Sequence: Synthetic polynucleotide
gaagacttaaggtggatatggagcaggaagcgcagctgcagcagcagctgctgcggccgctggtgctggagctagcagacaagtgggcatctacggaactgatgatggctttatcctagacggaggttacgactctgaaggttccgctgccgcagctgccgccgcggccgctgctgccgcctcctcttcaggaaggtctacagagggtcaccctttattgagcatttgttgtagaccatgttcacattcccacagttacgaagccagcagaatgccagtccattcaggtacgtcttc

SEQ ID NO: 2434 - DNA, 489 bp, Artificial Sequence
  Description of Artificial Sequence: Synthetic polynucleotide
gaagacttaaggtgctacgggtgctactggacctcaaggtatacaaggacctgctggagctacaggagctactggtgccacgggtccacaaggccctcagggcattcaaggtccagctggtgccacaggagccacaggtgcccagggtgcacaaggcccagctggtgcaactggtcctcaaggccctcaaggtattcaaggacctgccggtgccactggtgcgacgggagcccagggagctcagggaccagctggagcaacaggtgcaacaggagcaactggtgctcaaggcccacagggtgttcaaggtccagcaggcgccaccggagccacaggagcccaaggtccagctggcgctactggagctaccggcgccactggagctcaaggcccacaaggtgtccaaggaccagctggtgctacaggagcaactggagctcaaggtccacagggagttcagggtccggctggtgctacaggtacgtcttc

SEQ ID NO: 2435 - DNA, 534 bp, Artificial Sequence
  Description of Artificial Sequence: Synthetic polynucleotide
gaagacttaaggtgctacaggagcacaaggtcctcaaggcattcaaggtccagctggagccacaggtgctactggccctcagggtccacagggaattcagggtccagctggtgctacgggcgcgaccggtgcacaaggtgcgcaaggtcctgctggtgctacaggagctactggtgctcaaggtgcccagggaccagccggcgccacaggtgcaaccggcgccactggagcacagggaccccagggtgttcaaggaccagccggtgcaactggtgctcagggtgctcaaggagttcaaggaccagcaggagctaccggagctaccggcgctcaaggacctcaaggtgtacaaggtcccgctggtgcaaccggagcaaccggtgcccaaggtccccaaggcgttcaaggacctgccggagctaccggagccaccggtgctcagggtcctcaaggtgttcaaggcccagctggcgccactggagctactggagcgcaaggaccacaaggagttcaaggtcctgcaggtacgtcttc

SEQ ID NO: 2436 - DNA, 1041 bp, Artificial Sequence
  Description of Artificial Sequence: Synthetic polynucleotide
gaagacttaaggtctgcaaggtccacaaggaattcaaggtgttcctggtccagtgggtgccaccggtcctgaaggtcctcagggtattcaaggtattcaaggagtacagggtgctactggtccacaaggtccacaaggtattcaaggcatacaaggcgttcaaggaattacaggagcaacaggtgttcaaggtgctaccggtattcaaggcatccaaggagagatcggagctacgggtccagagggtccacagggtgttcaaggtgcacaaggtgccataggtcctacaggtcctatgggtcctcagggtgtacagggagtgcagggaatccaaggagccactggagctcagggtgtgcagggtccacagggtattcagggaattcaaggaccaactggagctacaggcgatatgggtgctaccggagctactggagagggagcaactggcccaactggtgtcaccggaccaactggagtgaccggaccttcaggtggccccgctggacccaccggccctactggtccttcgggaccagcaggagttacaggaccttcaggaggaccacctggtcctactggtgcaactggtgcaacaggaataacgggcgatactggagctactggctctactggagttacgggcgccactggcgaaactggtgccacgggtgttactggcctgcaaggtcctcagggaatccagggcgttcaaggagagatcggtcctactggacctcaaggtgtgcaaggtcctcaaggtattcagggagttaccggcgccacgggtgaccaaggacctcagggtatccaaggtccccaaggagatattggacctactggacctcagggtatacaaggaccccagggatcgcaaggaatccagggtgcaactggaggtaccggtgcacagggtccccaaggaatccaaggtccacagggtgatattggtccaaccggtccacagggtccgaccggtatacaaggaattcagggtgaaataggccctactggaccggaaggccctgaaggtacgtcttc

SEQ ID NO: 2437 - DNA, 867 bp, Artificial Sequence
  Description of Artificial Sequence: Synthetic polynucleotide
gaagacttaaggtgccacaggcgctacaggacctcaaggtgcgcaaggcccagccggagctacgggtgcaacaggcccacagggtgtgcaaggtaacacaggagcaaccggcgctacaggtccccaaggcgctcaaggaccagctggtgcaacgggtgcaactggtccccaaggtgttcaaggaaacacaggtgctacaggagccacgggtccgcaaggtgcccagggtcctgccggtgcaactggagctactggtcctcaaggtgtccaaggaaacaccggagcaacaggtgccacaggaccacagggtgtccaaggaaataccggtgctaccggagccaccggaccacaaggtgtacagggcaacacaggtgctactggagccacaggaccacaaggtgtccagggaaatactggtgctactggagctactggcccacaaggtgtgcagggacctgccggagcgactggcgcaacaggtcctcaaggagtgcagggaccagctggtgctacaggcgctacgggtccacaaggtaataccggtgctacgggagcaacaggccctcagggtgcacaaggtccagcaggagcaactggtgccacgggtccacagggtgtacaaggtaacactggtgctacaggtgctacaggtccacaaggtgctcagggtccagctggcgccactggtgcaaccggtccacagggtgttcagggtaatactggcgccacaggtgcaactggacctcaaggtgttcaaggtaacacaggcgctactggagccactggacctcagggcgttcaaggtcctgctggtgccactggagctacaggcccacaaggtgttcagggtaatacaggtacgtcttc

SEQ ID NO: 2438 - DNA, 1173 bp, Artificial Sequence
  Description of Artificial Sequence: Synthetic polynucleotide
gaagacttaaggtgctacaggtccaactggtgcaactggtcctactggagctaccggaccaacgggcgtaaccggcccaaccggagttactggcgcaacaggaccaactggtgttacaggaccgactggagccatgggtccaaccggtgctactggtgccaccggtccaacaggagttactggatccaccggtgttacaggtgctactggagctacgggtccaactggagtcactggtcctaccggcgctatgggtcctactggtgctacgggtgcaacaggcgctaccggtgcaacaggtgctaccggagctacaggtcctacaggtgttactggtgctactggtgctacaggtcctacgggtgtaactggagcaacgggcgctaccggccccacaggtgccactggagccactggcccgactggagctactggtcctacaggagctacaggtgctaccggtccgacaggtgccactggtgccatgggtcctaccggtgccactggacctaccggagccacaggacctactggagttaccggttctactggtgcgacgggagctaccggaccgacgggtgctaccggtgcaatgggtcctacaggagccaccggacctactggagcaacaggtccaacaggtgttactggatcgactggagcaactggagccacaggtcctactggtgctacaggtgctatgggtccaacaggagctactggccctactggtgcaaccggaccgaccggagtaacaggacctacaggtgaaactggtgctaccggaccaaccggtgctacaggccctacgggagttactggagctactggccccaccggcgtaactggtccaacgggagccaccggtgcaactggaccgactggagcgacaggtgcaactggtgctactggacctacaggtgttacgggtgccacaggtgttaccggaagcactggtgccacaggcccaaccggtgcaaccggtcctacaggcgcgacaggagccacaggagcaaccggcccaaccggtgttactggtgcaacgggtgccaccggaccaaccggcgtcactggtccaacaggcgctactggagccaccggagccactggagcaaccggagctactggagctactggacctaccggcgtaacgggagctgcaggtacgtcttc

SEQ ID NO: 2439 - DNA, 750 bp, Artificial Sequence
  Description of Artificial Sequence: Synthetic polynucleotide
gaagacttaaggtcctactggagctacgggacctaccggtacgactggtgcaatgggtccaactggagctactggaccaacaggaacaaccggcgcaatgggaccaacaggcgctacgggtcctactggtaccacaggtgccatgggtccaacaggtgctactggtccaactggtacaacaggtgctatgggacctactggagcaaccggaccaaccggtactactggtgcaatgggaccgactggcgccactggacccacgggaacaaccggtgctatgggtccaactggcgctactggacctactggagctactggtcctacgggcgtgactggtagtactggtgccacaggagccacaggagcaactggtccaacgggcgccactggcgccatgggccctactggagcaacaggtcctacaggagctacaggacctaccggagtgactggcgctaccggtccaacgggtgttacaggaccaactggtgcaactggtgccactggtcccacgggtgcaacaggagctacaggcgctactggaccgacaggcccgactggtgtcactggtgctgctggtgccaccggaccaactggagtaaccggtgcaactggtgttacaggtagtacaggagccactggagccactggtgctacaggtgcaaccggtcctactggagtcaccggtgccgctggagctacaggccctacaggtgccgctggcgccaccggtccagcaggtacgtcttc

SEQ ID NO: 2440 - DNA, 651 bp, Artificial Sequence
  Description of Artificial Sequence: Synthetic polynucleotide
gaagacttaaggtggtgcagaggaaaaagccatgaagccctctgagtctccagaatctgctaagaatgaggctggtggcgctgaggagaaggctatgaaaccctcgggttcggctgagtcggctaaaaacgaagctggaggtgctgaagaaaaagaaactaaaccttctgaatctcctgagtccgctaagaacgaggctcgcggtgccgagggaaaggaaaccaagccaagcgagtctccagagtcagctaagaacgaggccggaggagctgaagagaaagaaacaaaaccttctgagtctcccgagagtgctaagaacgaagctggaggagcagaagataaggctatgaagccttctgagtctgctgagtctgccaaaacagaagctggaggagctgaggaaaaggccatgaagccaagtgagtcgccagagtctgctaaaaatgaggctggtggagccgaagaaaccagcatgaagccatctggatcagcggaaagtgctaaaaacgaggcgggaggcgctgaagaaaaggagactaagccctccgagtccccagagtctgcaaaaaacgaggccagaggtgccgagggtaaagaaacgaagccttctgaaagtccagaatcggccaaaaatgaagcaggtacgtcttc

SEQ ID NO: 2441 - DNA, 924 bp, Artificial Sequence
  Description of Artificial Sequence: Synthetic polynucleotide
gaagacttaaggtgattctaacaccgatactaacactgataccaacaccgataaaaatttcgacgccaacactgatagcaatacagattcaaatactgaaacgaacaccgactccaacactgaaaccaacacagattccaacactgatacaaatactgattctaacactgacactaatacagacaaaaataccgacaccaacactgattctaacactgatactaatacagatacaaataccaatacggataccaatacggacactaataccaacacggatactttcacagataagaatactgattctaataccgacacaaacactgatacgcacacagacaccaattcggattccaatacagatactaacaaggacaccaataccgacaagaatacggatacaaatacagattctaacactgactcaaataccgatacaaatacggacactaacacagacactaacactgataaaaatttcgatgctaacactgattcgaacacggactctaatacagacaccaacacggactcgaacaccgaaactaatactgattcaaacacagacacaaacacggatagtaacactgatacaaacacggacaaaaatactgacaccaatacagactcaaacactgatactaacaccgataagaacactgataccaatacggattctaataccgataccaataccgattccaataccgatacgaatactgataagaatactgacacaaatacagactctaataccgacactaacacggattccaatactgacactaacatggatacgaataccgataaaaatactgatacaaagacggattctaatactgactccaatactgataccaatacagactcgaatactgataagaacactgacacaaagaccgattctaatacaggtacgtcttc

SEQ ID NO: 2442 - DNA, 600 bp, Artificial Sequence
  Description of Artificial Sequence: Synthetic polynucleotide
gaagacttaaggtgacatcagagatgcacgtgacgtgcgagacgctcgcgacataagagatatcagagacgcacgagatattcgagatccacgggacataagagacattagagattctagggatattcgagatattagagacgcaagagacatcagagacatgagagatcctcgtgatgttagagatgttagagatcctagagacgtccgtgatgtacgtgacatccgtgatgttagggatgttagggacatcagagactctagggaagtcagagacggtagagacgccagagaagtccgagatatcagggacgcgagggaggtccgagacatcagggacgctagagaagttagagacattagagacgccagggaggttcgagatattcgcgacccacgcgaagtgcgtgatacaagagaggtacgcgacgccagagaagtgagagacgctagagatgctcgtgaggttagagaggcacgtgaagctagagacgttcgtgatgcgcgagatgtacgagatattagagaagcccgtgaagttagggacgttcgagatgctagggaagtaagggatattagagacgttcgaggtacgtcttc

SEQ ID NO: 2443 - DNA, 543 bp, Artificial Sequence
  Description of Artificial Sequence: Synthetic polynucleotide
gaagacttaaggtaaagaatccgacagaagcaaggagagggaccgagagcgcgacagatctagggaaagggacagagaacaaggtcactctagagaaaaggaaagggagcattccaaggaacgtgaccgatctcgcggtcgtgaatctgaccgtggtaaggagtcagacaggggaaaggagagcgagaggggtaaggagagtgagagaggcaaagagtcagaaagaggaaaagagtcggagagaggaaaagagttcgatcgcggtaaagaatctgatcgaggaaaagaatccgatagaggtaaggaatcggatagaggaaaggaatctgaacgaggaaaagaatcagagaggggcaaggagtctgaccgtggtaaagaatcagataggggtaaagagtccgataggggtaaagaaagcgaccgtggcaaggaatctgatcgaggtaaggagtctgatcgtggaaaagaatcagatagaggcaaggaatctgaccgaggtaaggagagcgaccgtggtaaggaatcagaccgaggtacgtcttc

SEQ ID NO: 2444 - DNA, 378 bp, Artificial Sequence
  Description of Artificial Sequence: Synthetic polynucleotide
gaagacttaaggtagaccagagatgtaccctgagggtgttagaccaggaacggtcatttctggtgctgaacgtacttatccaggtggcgtcagacctggcactgttactcctggaactgaagaaatttacccaggtggtgcacgtcccggaacagtgacaccaggcatcgaggagatttacccgggaggtgtacgaccaggaacagttattccaggtgccgaaagaacgtacccaggaggtgtccatcctgacattgtcctaccaggagttgaaaagtcttatcctatagacatccgtccaggcacagttacacctggtgctgatggcatgtatccagaatctgtcagaccaggttcagtaaccccaggtacgtcttc

SEQ ID NO: 2445 - DNA, 693 bp, Artificial Sequence
  Description of Artificial Sequence: Synthetic polynucleotide
gaagacttaaggttctacaacccaaccaggttcgggatcaactacccaaccaggcagtggttctaccacgcaaccaggcagtggatctacaactcagcctggttccggatcgaccacccagcctggatccggctctacgacccaacctggatctggaagtacaacacagccaggtagtggttctactacccagccaggctctggttcgacgactcagccgggtagtggatctaccacccaaccaggaagcggctctactactcagcctggtagtggaagcactacccagcctggatctggttcaactacacaacctggtagtggatccacaactcaacctggttctggatccaccactcagccaggttctggatctactactcagccaggaagtggttctacgacacagccaggatcaggttccacaactcaaccaggtagcggttcaactacacagcctggttctggctccacaactcagcctggctctggttccacaacacaacctggttctggttctacaactcagccaggttccggatcaacaacccaaccgggatccggtagtacaacacaaccaggttcaggtagtacgactcagcctggttcaggatctaccactcaaccaggatccggatccactacccagccgggttctggttccactacccagccaggttcaggtacgtcttc

SEQ ID NO: 2446 - DNA, 501 bp, Artificial Sequence
  Description of Artificial Sequence: Synthetic polynucleotide
gaagacttaaggttctcctagaactacaacaggtggtggaatagcctacccaggtggtatcccgacgactacaacgggaggaggtattgcttacccaggaaacattcccaccactaccaccggaggaggtgtggcttatcctggtaatattccaacaacaacaactggaggtggcacggtttaccctggtggagtccctagtaccacgattacaggttctactgtctatccaggaggtgttccttctacaatcacgggtggtgatgttgcttatcctggagatgttccaagcacaactattactggtaccgtatatcccggaggtgtgtcctctgacggtgcagcttacccaggttctatgcccggcaccacgatcggaggtggcgttacttatcctggaagtattccatctactacgactggaggtggtatagcttactccggttcaatacctggaattacaactggtggtggagttacttacccacgaggtacgtcttc

SEQ ID NO: 2447 - DNA, 651 bp, Artificial Sequence
  Description of Artificial Sequence: Synthetic polynucleotide
gaagacttaaggtgttcctggaactattaccggcgcagatgctgttcatcccgaaggagttcctggtgcaacaaccggattgtcaattacgtatccaggtggcgtacctggtacagtgactggaggagatgttgtccaccctaagtccgcaccaggtactactacaggtagaggcgtcacctacccaggtggtgtcccgggaactgttacgggcggtggcgttgtgaacccaaaaagtgcaccaggaacaactacgggtcatggagtagcatacccaggtggcgttcctagaaccctaaccggcggatccacggtctatcctggaggagtctctggaattactacaggtggacatgttgcttatcctggtggtgtggcagctaccaccataggaggaaacgttgcctatccgggtggagtacctagcacaacaacgggtggtggtgttacatatccgggtggcgtacttggaaccaccacaggtgacggtgctgtttatccgggtggtttacctggaacagctactgtaggaggcattacctatcctggcattattagtggaactacgacaggatctggtatcgcatatcctggtggcgtacccggtacaaccactagcgacgatgttacatatcctggaggtacgtcttc

SEQ ID NO: 2448 - DNA, 501 bp, Artificial Sequence
  Description of Artificial Sequence: Synthetic polynucleotide
gaagacttaaggtcatcatggtatcccatgggatacgatggaatatccaggaaccccatggaatacgttgggacatcatggcattccgtgggatactatggagtatcctggtacgccatggaatacacttggacaccatggaattccgtgggacactatggagtatccgggaacgccttggaataccttgggtcaccacggtatcccttgggacacaatggagtaccctggtactccttggaatacccttggtcaccatggcatcccatgggacactatggaatatcccggaaccccatggaacactctcggtcatcatggaatcccatgggataccatggagtacccaggtacgccatggaatactctaggtcaccatggcattccatgggatactatggaatatccgggcactccatggaataccttaggacatcatggtattccatgggacaccatggaatatccaggtacaccttggaacacactaggtacgtcttc

SEQ ID NO: 2449 - DNA, 501 bp, Artificial Sequence
  Description of Artificial Sequence: Synthetic polynucleotide
gaagacttaaggtattcatcaagaggccacttcggaaattcaccctgaagccacttctgagatcccacctgagataacgtccgagattcatcctgaagctaccggcgaaattcaccctgagacgatttcaggaattcaccaggaggccacgtctgaaattcatccagaagccactagtgaaataccaccagagattactagagaaattcatccggaggccacgggagagattcatccggaaaccatatccggtatccaccaggaagctacatcagaaatccacccggaggctacttccgagattccacctgaaatcacctctgagatacacccagaggccacaggtgagatccatcctgaaaccatttcgggaatacatcaggaggcaacgtctgagattcatccagaagctacttccgagatcccgccagagatcactagagaaattcacccagaagccacaggtgaaatccacccagaaaccatctcaggtacgtcttc

SEQ ID NO: 2450 - DNA, 435 bp, Artificial Sequence
  Description of Artificial Sequence: Synthetic polynucleotide
gaagacttaaggtctgcctccgcaaaccacgagagagcttcattcccaatccgcctcagatttgcatcggccctcaacaagtcagatccatagaaggcctactagtaaaattcatccagacccaacttgcgagattcatcaagcctcaacctctgagaagcacccggaagcaacttgtgagatacatccggaatccacatctgagatcttaccagaaaccaccaatgacattcatcgaccatcagccaggcaaatcaaccgaccctcgacaagtgaaataccgcgcgagattaccagggaaattcaccctgaggccacctccgagactcacccagagactactaatgagatacacagaccgtcgacttctcaaatacaccgtccctccaccagccaaattttgcctgagacgaggagcgagttaggtacgtcttc

SEQ ID NO: 2451 - DNA, 750 bp, Artificial Sequence
  Description of Artificial Sequence: Synthetic polynucleotide
gaagacttaaggtccttggtccaaatgctccaaacactgcggagaaggtggtgaacaatcccgtggtatcaagtgtgaacaagtcatatcgggtggaattccaactgtggttgacgactcccagtgtcttgaaaaagttggtcccaaaggccctaccaagcaagaatgcaacaagaacgttacctgtccacagtttcacgtaggaccgtggaaaccttgtgaccatctttgcggtccaggtaagcaaactcgaaaggttacgtgttacatgaaggtcaacggtaagatacagttgcttaaagatcaagcctgtgagggcgaagtacctaagtctgaaaagccttgtgagctaagaccatgtgccggtcttgactgggttacaagtgactggtctggttgtgacgacaaatgcggtctgactgaagaaactcgtactacatactgcgctacccaagacggaacagtttacccagatgagaaatgtgacgccgaaaagaagcctgagttgactagagattgcgaagctgagaaagactgtgagtttttgtggttcgcctctcagtggtccgattgttctgcaaaatgtggaagtggtgtccagacaaggaaagttttctgtggaaccttcgatgatgagactgtaaaaaaagttccagatgaaaagtgcgacgccgacaaaaaattcaatgaaactaagtcttgtatagcaaaggaggagtgtaagggagaatggttcgcaggtacgtcttc

SEQ ID NO: 2452 - DNA, 411 bp, Artificial Sequence
  Description of Artificial Sequence: Synthetic polynucleotide
gaagacttaaggtgcaacagccgagagcgccgctacaactgagccaggcgctacaactgaatccgctgcaactgaaattaccgagtctacagaatctggagctactgaggttaccgagtccactgaaagtggtgctacgaccgagtctggtgccaccactgagtctggtgctactactgagtcaggcgctactactgaatcaggcgctaccactgagagcggtgctactattgaatccggtgcaacaactgaaagcggcgcgactacggagagtggagctactactgaaagtggcgctaccacagagtccgctgccacaaccgaaccaggtactacgatcgaatccggagcgacaaccgagtccggtgctaccaccgaatccggagccaccactgaatcaggtacgtcttc

SEQ ID NO: 2453 - DNA, 786 bp, Artificial Sequence
  Description of Artificial Sequence: Synthetic polynucleotide
gaagacttaaggtattggtggtcaaacgggtgctggacagccaggttatggttctcagccaggagtggcaggccaaaccggagcaggacaacctggttacggttcacaacctggtgtagctggacagaacggtgctggtcagccaggatacggatcgcaacctggagttgccggtcaaaacgtcgcaggtcagcctggctacggaacacaacctggcattggtggacagacgggtgcgggtcagcctggctatggctcacagccaggtatcggaggtcaaacaggcggtggacaaccaggttacggttctcaacctggaattggtggccaaactggtgctggacaacctggttatggttctcaaccaggtgttggcggacaaactggcgccggtcaacctgaagtcggtggacagactggtgccggacaaccaggatttggagctcaaccaggcattggaggtcagacaggtgccggacagccaggctatggcactcaaccaggaatcggaggtcaaactggtgccggtcaacctggatatggatctcaaccaggcatcggtggacagacaggaggaggacaacctggatatggttcccaacctggaatcggtggacaaacaggtgccggccaaccaggatatggtagtcaaccaggtgtcggtggtcagacaggtgctggtcaacccggttatggatcccaaccaggtgttggaggtcagaccggagctggacagcctggatatggttcgcaaccaggtgtgggaggtcaaacaggtacgtcttc

SEQ ID NO: 2454 - DNA, 564 bp, Artificial Sequence
  Description of Artificial Sequence: Synthetic polynucleotide
gaagacttaaggtgttggaggacaaactggtgctggtcaaccaggttttggcgcccaacctggaattggaggacagactggagcaggtcaaccgggatacggtacccaacccggaattggaggtcagacaggtgctggacagcctggttatggatcgcaaccaggtgttggtggacagacaggcgctggtcagccgggcgtgggaggtcagaccggtgctggtcaacccggttttggtgcacaacctggcattggaggtcaaactggtgcgggacaacctggatatggtactcaacctggtattggtggtcaaacaggagctggacaacctggttatggtactcagcctggtatcggtggacagacgggatctggccagccaggttacggatctcagccaggtataggtggacaaacgggtgctggtttgcccggttatggaacacaacctggaattggcggtcaaaccggagcaggtcaacctggatacggcagtcaacctggagtcgccggacagacgggagctggtcaaccaggctacggtactcaaccaggtacgtcttc

SEQ ID NO: 2455 - DNA, 837 bp, Artificial Sequence
  Description of Artificial Sequence: Synthetic polynucleotide
gaagacttaaggttatggttcgacgcagactgcaggcggtgattctgcactaacagcaggttatggttctactcaaacagccagggaaggtagtaatctcacagctggctatggctcgaccggaacagccggttcagattctagcctcatagctggttacggatcaactcaaacttcaggagaagattccagcttaactgctggatatggatctacacaaactgctcaagagggatcaaatttgactgctggttacggtagtaccggaacagcaggatcggacagctctttgatagctggatacggaagcacacaaacatcaggaggcgacagttctttaactgctggttacggctctactcagactgctcaggagggatccaatctcacttcaggttatggaagtactggcactgccggagctgattcaagtttgattgcaggatatggttctacccagaccagtggttccgactctgccctgaccgccggctacggatctactcagaccgcacaagaaggatctaatttaaccgctggatacggatcaactggaaccgctggcagtgattcttcgttgattgctggttatggatcaacccaaactagtggttctgatagttcgttgaccgcaggatatggttccacacaaactgcacaagaaggctcgaatttaaccgcgggctacggatcaactggtaccgctggtgttgattcttctctgatagcaggttatggatcaactcaaacatctggttctgattctgctttaacagcaggttacggatctacccaaactgcccaggagggttccaacctgacagcaggtacgtcttc

SEQ ID NO: 2456 - DNA, 471 bp, Artificial Sequence
  Description of Artificial Sequence: Synthetic polynucleotide
gaagacttaaggtgctggattaaatgcaggagctggtcttaatgctggtgcaggtcttaacgctggagcaggcttaaacgctggtgccggactgaaagtcggtgcaggactaaatgcaggagccggtctgaatgtaggagcaggccttaataccggcgccagattttctgccaatgctggtttgaaggcttcagctggactaaatgctggtgccggtctgaacgctggcgcaggactcaaggtgggtgctggtctaaacgctggagccggactgaatgtgggtgctggtttaaacactggtgcaggtttaaacgctaacgcgggattgaaggctaacgctggacttaacgctggtgctggattgaaagttggagccggattgaacgtcggtgctggactaactgccggaactggtttaaatgccaacgctggactgaaggcaaatgctggtttaaatgcaggtacgtcttc

SEQ ID NO: 2457 - DNA, 612 bp, Artificial Sequence
  Description of Artificial Sequence: Synthetic polynucleotide
gaagacttaaggtgtttgcggatgctcaggtggtcgacagctagttaatggagtttgcaaatgcacaggtggccaggaattggttggtggatcgtgtgcttgcacttgcggtcaagagttagtaaacggagtctgtacttgtccaggaggtcaaaaattggttggagacaaatgtatgtgtactggtggacagactatggtcaatgatgtttgtgcctgtactggtggccaaaccttggtggacggagtttgtgcttgtaccggcggccaaaagttggtcgacggagtttgtacttgcactggtggtagaagtttggtcgatggagtgtgcgcttgcacgggtggacagcttttcgctaacgacgtttgtgcctgcccagccttaatgtctctaaagaacggtgagtgctcctgtgacggcggtagagctgaagttcgccctgatgtctgcgagtgcacaggaggacaagagatcgcaaacggtgaatgtgcatgtacgggaggacaaactctcgtggatggtgtgtgccgctgcccttcgctcatgtcgctggaacatggtgtttgtacctgtgatggtggcaggactgaagttagcacaggtacgtcttc

SEQ ID NO: 2458 - DNA, 537 bp, Artificial Sequence
  Description of Artificial Sequence: Synthetic polynucleotide
gaagacttaaggttccacaactacgtccggaaatggatctggcacctcatcaaccacgaccaacaatggttcgggtgccggctccaccactacctccggtaatgactccggagtgggttcgactactacctctggtaacggttctggagctgagagtaccactaacggcaatgatagtggagtgggctctacaacaacctcaggagctgcctcaacggctacgtcagccaatggtagtggcgccgagtctactaccactagtggaaacggttcaagctctggttccactactacaagtggtaatggctcgggtgcagcttcaactactaatggaaatgactctggtgtaggttcaacaacgaccagtggtgctgcctctactaccacgagtggtaatggatctggtgtcggttctacaacttctagtggtaacggttccggaaccggttcgacctcatctggtattggaagtaccacgacttctgtgaacggtagcggaacaggtactacaaccagctcgggtataggtacgtcttc

SEQ ID NO: 2459 - DNA, 489 bp, Artificial Sequence
  Description of Artificial Sequence: Synthetic polynucleotide
gaagacttaaggtggtttgggagtgggaggactcggcgttggaggcggattgggtggcggatcgcattactcttcatcctcgtactcttctggtcatggatctggtgtaggcgttggagcaggattggcatcaggagctgctctcggcagtggtgcaggattagctaccggtgcagccctgggctccggagctggtcttgcaagcggagccggtctaggttacggtgcaggtcttgcttcaggagctgcacttggatctggtgctggtctagcaacaggcgccgcccttggaactggtgccggtcttgcctctggcgctgctctgggtagtggagcaggcctcgctactggtgcagctttgggttcaggagcaggactagctgctggtgctggactgggttatggcgccggccatgcctcgggagctgctctaggttctggagcaggactggcttctggagccgctttaggatctggaggtacgtcttc

SEQ ID NO: 2460 - DNA, 666 bp, Artificial Sequence
  Description of Artificial Sequence: Synthetic polynucleotide
gaagacttaaggtactggtgtttctggaggtccaggttacccaggaaccgtcggagctggacagtaccctggtgtaggcggattgccaggaacttccggacagtacccgggtggccaatacccaggtactggtgccggaggagtcccaggatattctggttaccctggtactagcggagccggtcattacccaggaacgtcaggcacgccaggtgccggaacaggacctggaactggaggtattggtcagcatggtggccagctgtctaccggaactggcgccggcgtaggacatcagggtagtggcgtaggtcaataccctggtacgggtgctactggtggctacccgtatccaggtacaaccggtcagtaccctggaacttctggtatcccaggtgcaggtactggtcaatattacccaggtggtactggagtaggcggtctacctggtggtgttggtcaacacggaggacaattgtccacaggtgcaggaacaggactaggtcaacaaggtggaggagtcggtcaatatccaggaactggcgttggtggtggaccaggatacccataccatcatggtacttcaggtcagtatccaggtggacaataccctggaactggagctgctggaggcccaggatatacaggatacccaggtacgtcttc

SEQ ID NO: 2461 - DNA, 441 bp, Artificial Sequence
  Description of Artificial Sequence: Synthetic polynucleotide
gaagacttaaggtccagctccatatccaacggccccaggtggtgtaggaaagattacctatccggtaggtccaggaggtgttccaggctaccctggaacccccacttatccatcaatccctggatatccaactcctggacacccagtaactgaaccgggataccctggcgtgccatcctatcctggcgctcctagaccaggtgtgccttctggtccatctggtccgagctaccctggtggtcaaattccaggatatcctggtgtcccttccccaggattcccaggaggacctccgcctggatacccaggagtgccaaccgctggttatccaggtattccaacaggcccaggtgttccgtcatacccaggtggaccttccgtgtcatttcccggagttccatcagtgcctccaggagttccgagttacccaggtacgtcttc

SEQ ID NO: 2462 - DNA, 645 bp, Artificial Sequence
  Description of Artificial Sequence: Synthetic polynucleotide
gaagacttaaggtgcaccatcaccaggttaccctggtgccccaagttcaggataccccggtgccccgtcccctggatacccaggtgccccttctccaggatacccgggtgctccaagtccaggatatcctggagccccatacccaggttacccggaagctcccactccttcatatccaggagctccaactccaggttatcccggtgctcctagtccaggttacccgggagctccagctcctggatatccggaagcaccatacccaggttatcctggtgttccaagcccgggatatccaggagcgccatctccgggttatccaggtgcgccgtcccctggttacccaggtgctcctagttcaggatacccaggtgcgcctagcccgggataccctggcgctccatctcctggttacccaggagccccatctcccggatatccaggagccccttatccaggttaccctgaagctcctactccatcctaccccggtgctccgacaccaggttatccgggagcccctagcccaggatatccaggtgccccagctccaggttacccagaggcaccatatcctggttaccctggagtcccttcacctggataccctggtgctcctagcccaggttatccaggtacgtcttc

SEQ ID NO: 2463 - DNA, 816 bp, Artificial Sequence
  Description of Artificial Sequence: Synthetic polynucleotide
gaagacttaaggtcttacaggtccagccggtcaggacggaaagcagggtccacagggtcctcgcggtttgacaggtcctgccggccaagacggaaagcaaggacctcagggaccaaggggattgacaggcccagctggtcaagatggtaaacagggaccacaaggtcctcggggtttgactggtccagctggtcaggacggtaaacagggtcctcaaggaccacgtggtttgactggtcctgccggacaggatggcaagcagggaccaagaggactgaccggaccggctggtcaggatggtaaacagggccctagaggtttgaccggtccagcaggtcaggacggtaagcaaggacctcaaggtccacgcggactgacaggtccagctggtcaagacggaaaacaaggaccacagggtcagcctggacaagttggtcctagaggtctacaaggtccccagggtccacgtggagataaaggagagactggaccacagggtccagcaggcaaagacggcgaggctggtgctcaaggtcctgtaggtccggctggtccgcaaggacctcgtggcgataaaggtgaaactggtcctcaaggacctgctggaaaagatggcgaaagaggtcctgttggtccagccggtaaagacggtcaaaatggaaaggacggattgcctggcaaagatggtaaggacggacagaacggaaaggatggtctacctggaaaggatggtaaggacggccaggatggtaaggatggacttccaggtaaggacggtaaagatggacagccaggaaagccagcaggtacgtcttc

SEQ ID NO: 2464 - DNA, 561 bp, Artificial Sequence
  Description of Artificial Sequence: Synthetic polynucleotide
gaagacttaaggtgacaccggacctactggtcctactggcgcttctggtccttcaggtgagactggacctacgggaccaacgggtgtttctggacctagtggagaaacaggtccaactggacctactggtgcctccggtcctagtggcgacactggcccaactggtccaactggtgcttccggaccttcgggcgatactggccctactggtccaactggcgcaagcggccctagtggtgagacgggaccaacaggtccaaccggagcatccggaccttcaggcgagactggtccaaccggcccaacaggcgcatccggtccaagcggtgaaactggtcctactggaccaacaggtgcttctggtccatcaggagagactggtcctacaggtcctaccggtgtatcaggtccatccggtgatacaggaccaacgggaccaactggcgctactggcccttctggcgagactggtcctactggtcctaccggcgccactggtcctagtggtgaaactggtccgactggtccaactggagctactggcccttcaggtacgtcttc

SEQ ID NO: 2465 - DNA, 843 bp, Artificial Sequence
  Description of Artificial Sequence: Synthetic polynucleotide
gaagacttaaggtaaccaaattcttgatcctcgtacgtgcgtttgtaagaagtgtattgctactgcctgtcctgataattcgcattattctttctctacttgtagatgcgaatgtccacaacaccagaagtgccctcatggtcagtactttaattccgagacatgcaaatgtggatgttcccctcatatcaaatgccacagtcctagggtcctgaacaaggatgcttgtaagtgtgaatgcccaaagaacgtacactgtttaccacctttaacttttgatgagagaacatgtgcatgccactgtccagaacaccactcccactgccctacaggtaagatttattcttacacagaatgcggctgtatttgctccgagaaagcttactgtcatcttcctagattttttaacaacgagacttgtaaatgcgagtgtaagggtgaaaggaactgtgtacatcctaaggtctactccgagacgaactgtaattgtcaatgtccagaagatgactactgtccgcggcataagaccattaaccctgaaacctgtgaatgcagttgtccagcagaactcagctgtagaagtccacaagtgctaaacgacaaaacttgcaagtgcgtgtgtccaccacatactagacgatgcccaccaggaaaggagcttgatgatttcacctgtgagtgtagttgtcctgaggttttttgtcctttgccgaagctgcaaaacccttatacctgtaagtgtgcttgccctgataccctgacctgtccttacggacaagttgtagatccagagaactgtcagtgttcctgtccaaaaaaactatcctgttcaggtacgtcttc

SEQ ID NO: 2466 - DNA, 507 bp, Artificial Sequence
  Description of Artificial Sequence: Synthetic polynucleotide
gaagacttaaggtaatcaggatcatggttacggtgtcaggccattagtcgacggtcaataccgcggctctggtactaataacaaacttccgggtaaccagtatcaaggttatggtattacaccttctattgacggacaatacacttctagtggtacaaacaataagttgcctggaaaccaaaatcagggatacggaattaacccttccatagtgggtcaatatccgggattgggcacgaataataatttgccaggaaatcaggatcacggttacggcgttagaccattggttgatggtcaatataggggaagtggaacgaataacaagctgccaggtaaccaataccaaggatacggtattactccttctatcgatggtcagtacacctcctctggaacaaacaataaactgccaggtaatcaaaaccaaggctacggaattaatccttctattgtgggccaatacccaggtttaggcacaaacaacaaccttccaggtacgtcttc

SEQ ID NO: 2467 - DNA, 516 bp, Artificial Sequence
  Description of Artificial Sequence: Synthetic polynucleotide
gaagacttaaggttcaggcggttcgggtgttcagcagagtggtaacgtaccatctggagttaatatcaatcaaattcaaccatcctatggacaaccgcacggtacactttacagtggtggaaccggtgtgcagcaaccaggctatgcatcttcgggtgaaaacttgaacccgattcaaccttcatatggtcaacctcacggtaccttaggtagcggtggctctggtgttcaacaaagtggtaatgttccttcgggtgtcaacattaatcagattcaacctacctacggccagccacaaggtaccctaggttcaggaggatcgggtgtccaacagagtggtaatgtaccgtcaggaggaaacttaaatccaatacaaccatcctattcccagcctcacggtacactgtatagtggtggtacaggtgtccaacaaccgggttacgctagttccggaggtaacttgaacccaattcaaccttcttacggtcaacctcatggcaccttaggtacgtcttc

SEQ ID NO: 2468 - DNA, 825 bp, Artificial Sequence
  Description of Artificial Sequence: Synthetic polynucleotide
gaagacttaaggtggcgacctccctgataaacctattccaggtggtcaggaagaggttgaaagaccttggccagaaacgggagatcttcctgataagccgattgagactgatcagtttgataccacagctggacctagtttctgggataccactcattctgatcacactgagtcaatggaaatattcgaagttccaccgaatgagattgatgacggtggtgatctgccagacaaaccaatacctggtggacaggtggaacaaccaggaccaggcatcgacggtctgccagataagccaattgagacggatcctttcgacactactactgatggctccttttgggacacaacgcattccgaccataccgagcctatggaaatatttgaagtccctggttcagaaatcgatgatggcggagatttgccagataagccgatcccaggcggtcaggtcgagcaaccttggcctggtccagatgacttgcccgataaacctcttaacattgaccctagtgatacaacaactgattctagcttctgggatactactcactcagatcataccgtgccgatggaggtgtttgaggtcccaccaaacgagatcgatgaaggcggaggattaccagacaagcctataccaagtgatagagatcatgttgagcagcctgagcctgagactggtgacttgccagataaaccaattggaatcaacccttcagatactactactgattcttcattctgggatactacccactttgatcatactgtccctatggaaatcttcgaggttcctccttctgaaatcgacgaaggtacgtcttc

SEQ ID NO: 2469 - DNA, 1038 bp, Artificial Sequence
  Description of Artificial Sequence: Synthetic polynucleotide
gaagacttaaggtggagttgtgccagtgatccctggaggaccaaatataccaggtggtcctggagatccaataggtcctggtggaccagttgaaccaggaactcctgaaggtccagacggtccgggaataccaggaggtcctaacggtcctggcggaccgggaattactgaaggtcctaatgagagtaatcatcttactactaagatcccaatcactactaccacagatagaaacggaggtggagtagttccagttttacctggcggtccaggtggtcctcgcaaaccaggtggtcctagtggcccaaatggccctggtaatcctggtggacctgttaatccaggtggtccgactggtccagatggacctggaaacccaccaggctctgagacaccaggaggttctggaacgcctattggacctaacggtccagttggaccaggatcaccggatggtccacgtggtccttcaggtcctgatggaccgaaaggtggcacacagaatacaggatcccctagtggtccttctggaccggataacccaaatggacctggaggcccatcgaacccaggtggtccgagtggtccaactggacctgaaggacctgacgaatccaatcggttatcgaccaaaattcccataacctcgaccaccacagatagggttggtggcggtattcctgtgattccaggtggacctaacattccaggtggcccgcgaggacctagcggaccgtccatccctggcgagccagcgggtcctgacggatcaggaggtcctggtggtccagttaatccgggaggtccgaccggtcctcatggtcccggaaatccacccggtccatctattccgggcggacctggaggacctgacggtccaggatcgccatcaggtcctagtggtcctgattctcctggctcgccaaatggtccttctaacacaggttcccctagaggtccatctggtccagatggtcctaaccagcaaccaacatctaaaccggagaagcaaaacgaacaatcttcaggtacgtcttc

SEQ ID NO: 2470 - DNA, 861 bp, Artificial Sequence
  Description of Artificial Sequence: Synthetic polynucleotide
gaagacttaaggtaccaattctactgcaagcggagataattctacagcttctggaactaacgcttccgccaccggtgaaaactctactgcgtcgggtacgaatgcttctgctactggtgagaactctactgctactggaacagcctccacagccagtggttcaaactctactgctaacggtaccaactccacggcatcaggagagaatagcacagctaccggtacggatagcactgcttcaggaagtaattctactgctaatggtactaattctaccgcgtcaggagacaatagtacagcctcgggaactaacgcctccgcgacgggagagaactcgaccgctacaggaaccgattcaactgcatctggttctaactccactgctaatggcacaaattctactgcatccggtgacaattcaacggcctcgggcactaatgcgtctgcaactggtgagaacagcacagctacaggcactgactctaccgcttccggttctaattcgacggctaatggagctaactccacagcctcaggagataattccaccgcttcgggtacaaacgcctccgcaaccggtgagaactctacggctactggcactgattctactgctagcggttcaaatagcacagcgaacggaactaatagtactgcctcaggtaacaattctacggcaagtggaacaaatgcatccgcaacaggtgaaaattctacagcaaccggaacggactcagcagcttccggtacaaactcaacagctaacggtactaacagtactgcctcgggagataactcaactgccagtggtacaaatgctagcgctaccggcgaaaattctactgctacaggtacgtcttc

SEQ ID NO: 2471 - DNA, 771 bp, Artificial Sequence
  Description of Artificial Sequence: Synthetic polynucleotide
gaagacttaaggttcgggattgagtggagtttctatggctggtagcgaatgttctggagcatcaatggctggatcgggtcattctagagtctcagtcgcaggatctgagtatactggtgcttcgatggcaggcagtggtcatagcagagcctcaggagcaggatctgaatggagtaggactagcatggccggttctggactctcaggcgtttcagtcgccggttctgagtaccctggagctagtatggctggttccggtcactccggtgcccctgtttcaggtagcggatcctccggagcaagcatggcaggatctggactttctcgtgcctcaggtgccggatcagaatgttccagaacatcggttgctggctcaggtcattctagaacgtctgtagctggatccgaatgttcacgggtttcacgagcaggtagcgaatgctccagggcttcggttgccgattctggatactctggagcatctgaggtaggttcaaggtcaagcagagcatctcttgctggattagtacacttcggagcttctattgcatgcagcggtcattctgaagcaagtatggaaggtttggaatgttccggcgcctccgttccagactcaagacattctgtcgctagcgtaacggatggtggtcactctgtagcttccgttgctgactcagtgcatagtgttgttagtatgactggtttaggacagtttgtgtcctccgtttctgaacctggtcatagtactgcctctgttgcaggtacgtcttc

SEQ ID NO: 2472 - DNA, 477 bp, Artificial Sequence
  Description of Artificial Sequence: Synthetic polynucleotide
gaagacttaaggtattgcaactccgagtgataccaactcttatgagtccaccactacagtgactgacatgaccacgtcaacacataccactgtcgttactacaacctggttggtgacaaatagtgacggctctgttgaaaccgagacgggaatcgcgacaccttccgacactaatagttatgaaagtaccactaccgttaccgacacaacctttactacggaaacaaccgttatcactaccacttggttagtgacgaagtccgatggttccgtcgaaactgaaactggtgtgattactcagtcgggtgattcaagtagcactatcactacgtttgagacatcaagtgacacgaacagttacgattcaacaactactgttacggatactaccacaacaacggaaactactgtttttaccaccacatggatcgttactaaatcagatggcagcgtcgaaacagaaacaggtacgtcttc

SEQ ID NO: 2473 - DNA, 1101 bp, Artificial Sequence
  Description of Artificial Sequence: Synthetic polynucleotide
gaagacttaaggtgaacctactggtagcggttctgaatccaccggagaaccgaccggagagccttctggatcaggatctgaatccaccggtgaaccaactggagaacctacaggagagccatctggttctggatcggaaagtactggtgagccaactggtgagccatctggttcaggttctgaatctgctggtggatccagcactccaggatattctgtttctactaccactgatactactacaactacagagacaaccaccactactactaccaccacatggactgttactaagtcagatggaagtgtcgaaacagaatccggtattgttagtggctctgatagtagtctgacgacaatcactacatttgaaccaccatcgagttcctctggatttggtactgaaagcggcctgattacggatacgaacaacgagtcatctgcgggatctactggtggcgcctccgagccgactggaggtgcctcggagtccaccggtggagctagtgagcctacaggagaacccacaggtggagcctccgaaagcacaggtggtgcatcggagccaaccggtgaaccaagtggtggcgcctcagaaagtactggaggagcaagtgagccaaccggagagccaactggaggtgcaagtgaatcaactggtggtgcatctgaaccaactggtggtgcttccgagagtacaggaggtgctagtgaacctacaggaaacggttccgaaagcacgggtgaaccaactggcgagccgacaggtggtgcctcagaatctactggaggagctagtgaaccaacgggagagccaacgggtggcgcttctgaatctaccggaggtgcatctgaaccgactggagaacctactggaggtgcttcagaaagcaccggaggagcttccgagcctactggagagccaaccggaggtgctagtgagagtactgatggtgcttcggagcctactggtgaacctacaggaggagcttctgaatcaacgggaggtgcttcagagccaaccggtgagcctactggtaacggctccgagactactggtggatcttccactccaggatactcagtatcaggtacgtcttc

SEQ ID NO: 2474 - DNA, 654 bp, Artificial Sequence
  Description of Artificial Sequence: Synthetic polynucleotide
gaagacttaaggtgataatggaactggatcaggtaacaccggtgataatggtacgggctccggcaacacaggagataatggtaccggatccggcaacaccggcgataacggaactggttcgggaaacaccggagacaacggtacaggtgctggcgacaatggtacaggtgctggagataacggcactggttctggtaacactggagataatggcactggatctggtaataccggtgacaatggcactggttctggcaacacaggtgataacggcacgggatccggaaataccggtgacaacggaaccggtgctggtgataacggtactggagctggagacaatggtaccggaagtggtaacacaggagacaacggtaccggatccggcaatacaggtgacaacggtactggttctggaaataccggcgacaatggtaccggtgctggtgacaatggcaccggagccggtgataacggaactggatctggaaatacaggcgacaacggaactggtagtggaaacacaggtgataatggaacaggtgcaggagacaacggaacaggatctggtaatacgggtgacaacggaactggcgctggcgataacggtacaggttccggtaacactggtgataacggaacaggtacgtcttc

SEQ ID NO: 2475 - DNA, 714 bp, Artificial Sequence
  Description of Artificial Sequence: Synthetic polynucleotide
gaagacttaaggtgcccaaggtccacagggtgttcagggtgtccaaggtgatcaaggtcctcaaggtgttcaaggtgctcaaggcgaccaaggaccacaaggcgttcaaggagttcaaggagatcaaggacctcagggcgtgcagggagtacaaggtgaccaaggcccccagggtgttcaaggtgttcagggtgatcagggacctcaaggcgtgcagggtgttcagggagatcaaggtccacagggcgttcaaggagcccaaggtgaccagggtcctcaaggtgtgcaaggagtgcaaggtgatcagggcccccaaggagtccagggagttcagggtgaccagggtccacaaggagcgcaaggtgtgcaaggtgatcaaggaccgcaaggagtacagggtccgcagggtgatcagggtccacaaggtgtccagggtgttcaaggagatcagggaccacaaggtgttcaaggagtgcaaggtgctcaaggtcctctgggtcctcaaggtatccaaggtccgttgggagcacagggcccattgggtcctcaaggtgctgagggtccattgggtgcccaaggccctcttggccctcaaggtgcagagggtccactaggagctcaaggcccattgggtccccagggtgcagaaggtccccttggtgcacaaggtcctcttggtccacagggtgctgaaggtccattaggtacgtcttc

SEQ ID NO: 2476 - DNA, 1023 bp, Artificial Sequence
  Description of Artificial Sequence: Synthetic polynucleotide
gaagacttaaggtataggaggaatcccaggcgctgtacctggtactggactgggaggcgttcctggactcacccctggtggaggcgccgtacctggtgttgtgccaggtcttgtgcctggagctggtggtgttcctggtgcaggtataccacaacttggagtacaaccaggtgccaaagcctctaaatacggattgcctggagttggaggtgtgccaggtgtcggaggtgttccaggtgtaggaggtgtgcctggcgttggtggagttccaggcgttggtggcgtcccaggtgttggtggtgtcccaggcgttggaggtgttccaggaccaactatttctggactaggtgcaaaaccaccaaagataggtggagtcggtgccggaggttttccagctggagtgggcgtcggaggtgtcccaggtgccggtgcttaccctgctggaggtaaacctccaaaaccaggatatggagctggagctggactgattccaggaggtggtattactcctggagctggcttgggtgctggtcttgttcctggagctggaacaggagctggactctaccctggaggtaagcctcctaaacctggatatggcttgccaggcggtgcacttacaccaggagcaggactgcaaccaggcgccggtttgcagccaggtgctggactgcagccaggagcaggattgcaacctggagccggcttgcaacctggtgcaggcctccaacctggagcagcaactggtgccggtacatacccaggaggtaaaccacctaagcctggtcttggtattggcggacttacacctggtgttgctggtctaggaccgggtgccggactggtgccaggagcgggaggtttagctccaggtgccgccggaggtgcataccctggaggaaaacctccaaagccgggcgccggcttagttcctggtgccggaggcctcgctccaggagctggaggtttggctccaggcgccggtggccttgttccaggtgccggcggattaggtacgtcttc

SEQ ID NO: 2477 - DNA, 897 bp, Artificial Sequence
  Description of Artificial Sequence: Synthetic polynucleotide
gaagacttaaggtggaatcgcaacgggcgttgctccaggtggagccggtggtctgtacccaggtgcaggaggaaagccaccaaaacctggatacggtccaggagctggttttgtgccaggtgcaggaattggtgccggcgccggagctggattacaacctggtggaatcggagcaggagttgctccgggtggtgtcggagctggtggactctatccaggagccggtggaaaaccacctaagcccggttatggacctggtgctggttgggtccctggtgccggagttggcttgggtactggagtccagccaggaggtactggtacaggcgttgccccaggaggaatcggcgctggcggactttatcctggtgcgggaggtaaacctcctaaaccaggatacggacttggcgccggattagtgccaggagctggtgtgggtcctggagctggtctgcagcctggaggcatcggtgccggtggtgtcggagccggtggattgtacccaggtggtaaaccacctaagccaggatacggacctggtgcaggttacgttccgggtgcaggttatgtaccaggtgcaggagtcggtcctggagccggtctacaaccaggaggcattggtgctggtgttgcccctggtggtgttggcgctggaggtttgtacccaggaggtaaaccacctaaaccaggttacggacctagagccggactgggtacaggcgctggtatcggcgctggactccagccaggcggaattggagccggagtggctccaggaggtgttggtgctggaggactatatccgggtggtaaaccacccaagcctggatatggtccaggtgccggttttgtcccaggtgttagcaatggagctggacagcaaccaggtacgtcttc

SEQ ID NO: 2478 - DNA, 777 bp, Artificial Sequence
  Description of Artificial Sequence: Synthetic polynucleotide
gaagacttaaggtggtccaggtggagcaggaggccctggtgttgatgcacacggtcgacctactggtggctctggtacaggaggacctctggtagatgcatacggacgacctatctcaggtggtcatggtggtagacccgccggtggctcaggaacttcgggtggaccaggtgtcgacgctcatggtcgtcctattggtggtagtggaaccggaggtatcgacggtcaaggtcgtccatccggaggtaccgctgtggacgcctacggaaggccgattggtggtccaggaaccggatcaccaggtagcggtggtgcaggtaccggagttcctggtgtagatggtagaggcagaccttctggaggtccaggagtggatgcccatggtcgaccaattggaggtacgggagcaggcggtcctggtacaacaggtactggcaccggtggtggagttgatgcttatggacgtcctatcggaggtcaaggtactaatggtcacgacgcaaggggacctccagtcgattcacatggacgtcctattggaggtcctggaactggaggattaggttccccaattggaaccggtatcggcggtgttgacgcctacggtcgtccttctggacctggcggacaaggatctggtaccccaggaggtgcacctggtcactcgggactaggtacaggaggtcacggtgtagatgctcacggacgacctattggaggaccgggtacgggcgtctcaggtgttgatgctcatggacgtcccataggtacgtcttc

SEQ ID NO: 2479 - DNA, 750 bp, Artificial Sequence
  Description of Artificial Sequence: Synthetic polynucleotide
gaagacttaaggtgtcggccagtatccttctggtacaggtgccggtcaatacccttcaggtactggtgcaggacaatacccttcaggaaccggaggaacatctggtactggtcagtatcctggtggtactggtgccggacaatatccaggtggcattggcggaaccggtggcgtgggtcaatacccaggtagtaccggaacaggtcagtatccaggaggaactggcggtacaggtggtgctggtcagtatcctagcggcacaggtgctggacagtatccatctggtactggtggtaccggtggtgcaggacagtatcctggttcaaccggtgttggacagatacctggaggaacaggtcattatccatccggcacgggtgctggtcagtacccttccggaacaggaggtaccggaggtgctggacaataccctggatctacgggtgctggtcaacatcctggaggccttggtggtacaggtggtacgggacaatatccatctggtaccggtgcaggccagtacccatccggtactggaggtactggtggagcaggtcaatatcctggttctggacaatacccatcaggtactggaggtaccggttctgctggtcaatatcctagtggaactggcggagcaggacaatatcctaccggaacgggtggagccggaggagtaggacagtacccttctggcaccggcgctggtcaatatccaagtggcactggcggaattggaggtacgtcttc

SEQ ID NO: 2480 - DNA, 684 bp, Artificial Sequence
  Description of Artificial Sequence: Synthetic polynucleotide
gaagacttaaggtattggtggccagacaggtgcaggtcaaccaggttatggtagccaacctggaattggtggtcagacaggcgctggtcaacctggatatggatctcaacctgttgttggtgctcaaacaggcacaggacagcctggttatggagctcaaccaggtgtcggtacacaaactggtgctggtcaaccaggctatggttcacaaccaggtatcggaggtcaaacaggtgctagacaaccaggttatgtcacccaacctggagtcggtgctcaaactggaatcggacaaccaggttacggagctcaacctggtattttaggacagactggtgctggacaaccaggatatggttctcagccaggtattggcggacagacaggtgctggacagcctggttacggcacccagccaggagtgggtgctcaaactggcaccggtcaacccggttatggcgcccagccgggtgtgggtacgcagacaggcgcgggtcaaccaggatacggaagtcagcctggtattggaggacaaaccggagccggacaacccggctatggaacacagccaggtgtgggagctcaaactggtgcaggccaaccaggctatggagcacagcctggtgttggtgcgcagactggtgctggccagccaggttacggttcgcagccaggtacgtcttc

SEQ ID NO: 2481 - DNA, 789 bp, Artificial Sequence
  Description of Artificial Sequence: Synthetic polynucleotide
gaagacttaaggtatcggtggacaaactggaggtggacaacctggatatggttctcagattggcggtcagactggtgccggtcaaccatcatatggttcacagccaggagtgggcgctcaaaatggagctggtcaacctggatacggaactcaacctgtgattggtggacaaacaggcgctggacaaccaggatatggcggccagacaggagtgggtggaagccctggttttttgacccaaccaggcattggtggcatttctggacctatcggtggaaagttaggcggtggtcaaagcgaggcagcaaagccaggatattgggcacagccaggaattggtggaccatccaggtacggatctcaaccaggtatcggtgatcagactggtaccggtcaatccggatacggtggtcaaccaggaatatctggacaaacaggaggtggacaaccgggttatggaggccaagctactatctccggtctgcctggatacggtacacagccaggtatcggtgccttgaccgcagttcctggtggtcattatggttacgagactcaacctggtattggtggccagactggaacaaaccagcctggttttggtggtcagcctggaataggtggacaaaccggagcgggacaacctggttatggtttcatcggtcaaccgggtattggaggacaaaccggaacctccggtcgccagccaggttacggtacacagcctggtatcggtggtcagactgcagccggtcaaccaggatacggctctcaaacaggtacgtcttc

SEQ ID NO: 2482 - DNA, 777 bp, Artificial Sequence
  Description of Artificial Sequence: Synthetic polynucleotide
gaagacttaaggtgctgatggtgctgatggtgtggatggagttgatggattaggttggactggtggttcctatgaccctcttaccggcgtcgttactttcacgtctgatgacggcttgggttttgttacaggtgacttaaggggagctgatggtgccgatggtgtagatggtgttgatggtgccgttggacctcagggtccagagggtccacaaggattgcaaggagacactggtccacaaggacctcaaggcctccaaggtgagcaaggacttcaaggacctcagggtctacctggtgccgacggagccgacggagcccaaggaccgcaaggaatccaaggagagcaaggtttacagggtcctcagggtttacctggtgccgatggagctgattctaccgtccctggtcctcaaggccctaagggagacaaaggtgatactggtgacgctggtccacagggacctaaaggcgatactggcgacgctggtccacaaggtttgaagggtgatcctggaaatgatggagctgacggcgctactggacctgaaggacctcaaggtccacaaggaaacccaggcgctgatggcgctgacggagcccagggacctaaaggtgacaagggcgacacaggagatccgggagcacaaggtcctcaaggcaatccaggtgaccagggaccacaaggaaatccaggagcagacggagcggatggagctattggccctgagggtcctcagggtccacaaggaccagagggaccagaaggtacgtcttc

SEQ ID NO: 2483 - DNA, 954 bp, Artificial Sequence
  Description of Artificial Sequence: Synthetic polynucleotide
gaagacttaaggtccatacggctcctccttgggatactccgccttttatggttctagagtcggtccctttggcacttacggtacgagcggtctgtttggctctggatacggtccgtttggccatttaggaccttacggtagtgctttgggatactctggtctatatggatcaagactgggtccatttggaacctacggtacaagcgctctatacggatctggatatggaccttttggtcatttaggaccatacggcagtaccttgggatactcaggactctacggtagtagattgggaccatttggtacgtatggcacgtccggtgtattcggttcaggttatggtcctttcggacacttaggaccttatagctcaacacttggatattctggtttgtacggatcaagactgggaccattcggtacctacggtacttccgcattgtatggatccggttatggaccattcggacacctaggaccttacggatcaactttgggctatagtggcttgtattcctctcgtttgggcccatttggaacttacggaacaccgggtcttttcggttctggatatggtccatttggtcatttaggtccatatggatctacgttgggttactccggcctatacggtagcggtctaggcccatttggaacatacggcacatccttattcggttctggatacggtcccttcggacaccttggaccatacggtagttccctgggctattcaggactttatggctcaagtttaggtccttttggtccttacggaaccagtggtctttttggatctgtctacggcccttttggtcatttgggtccctatggatcgactctaggatattccggattgtacggttcccgcttaggtcctttcggaacttatggtacttcaagtttatatggttccggatacggcccttttggccctctaggtacgtcttc

SEQ ID NO: 2484 - DNA, 675 bp, Artificial Sequence
  Description of Artificial Sequence: Synthetic polynucleotide
gaagacttaaggtccatccagtggcgcaagtggacactctggaccatcctccggtgcctcaggccatagtggaccatcctcaggtgcatctggtcacagtggcccaagtagcggtgcttcaggacattctggacctagttctggagcatctggacatagcgttacgtcgtcgcataccggaccttcgagtggtgcctcaggtcactccggtccctcttcaggagcctcgggtcactcaggcccatcttctggtgcttccggacacagtggaccctcatctggtgcatctggccactcagtgacgtcaagtcatacgggtccttctagtggtgcaagtggacatagtggaccatctagcggtgcctcaggacactctggaccttcttcgggagcttccggacattctggcccatcatctggagcgtcaggtcattctggtccttcatcaggagcctccggtcattcgggaccatcctcgggtgcctccggtcattctgtaacctcttctcacacaggtccatcttctggtgcatctggtcattccggaccatcgagcggtgcttctggtcattcaggtccatcgtcaggagctagcggccactctggtccaagcagcggagcttccggtcacagcggcccatcatccggtgcttctggacactcaggtacgtcttc

SEQ ID NO: 2485 - DNA, 846 bp, Artificial Sequence
  Description of Artificial Sequence: Synthetic polynucleotide
gaagacttaaggtataggtggaggccaacctggaattggtgttcaacctggatatggaggacaaactggtggccaaccaggatatagaggacaaactggaacaggaacaggtcaacctggttatggtggtcaaaccggaataggtggaggtgcaacccaaccttcgtacgctcaaactggtggacaacctggttacggtggaggtcagcaggtccaaccaggatatggtggacaaacaggagccggtcagcctggatatggaggtcaaatcggaacaggtcagcctggatacggcggtcaaactggtataggaggtggtcaaccgagtactggtattcagcctggctacggagcccagcccggctacggaggccagaccggaactggaactggccaaccaggttatggaggtcctgcgggcactggtcctggtctaccaggctatggtggacaaactggtactggtgcaggtcaaccaggatttggtggtcagactggagccggtcaacctggttttggaggacagaccggaactggtgtgggccagccaggttacggcggccaagctggaacaggacaaccaggttacggaggtcaaactggaggtcagcctggttatggaggtcagactggcactggcacaggacaaccaggatacggtggccagactggaattggtggtggacagcctggttacggtggtcagacaggaacaggaaccggcaagcctggttatggtgagcagaccggtacaggagcagctcagcctagctacggacaaacagctggccagcctggctatggcggtggccttccaggacaacttgtccaaccaggtacgtcttc

SEQ ID NO: 2486 - DNA, 498 bp, Artificial Sequence
  Description of Artificial Sequence: Synthetic polynucleotide
gaagacttaaggttacactccatctggtaagagttctgagtccagcatgaacacagcttcgtctgagagttcgatgaatacggcgagctcagagagttggataaagactgcctcctccgaatcttctatgaacactgcctcttccgaatcgtctatgaatacagcttcttcagaaagttggatcaatactgcttcatccgaatcttcaatgaacactgctagctctgaatcctggataaacactgccagtagtgagtctagtatgaattcggcgtcgtcagagagttggatcaatacagcttctagtgaatcctggatgaacactgcttcatcagagtcttggattaacactgctagttcagaatcgtccatgaacaccgcgtcatctgagtcctggataaatacagcttcaagtgagagtagtatgtccaccgcttcttccgaatcttggattaatacggcatccagtgagtccagcatgtctacaggtacgtcttc

SEQ ID NO: 2487 - DNA, 867 bp, Artificial Sequence
  Description of Artificial Sequence: Synthetic polynucleotide
gaagacttaaggtacaacaacgtacagagtttcaggtagttcctcggcttcctccgacgtcccaccagtatatactacaacagtcacatcaggaagctcaaccgagactgacgttgtgagtgaatatagtacaaccgactctaatggaatgcctagtacgggtactactacataccacgttagtggatcttcatccgcgagtagcgacgtacctcctgtatacaccacgaccgtgacatcgggttcctctactgagactgatgtcgtatctgaatactccacgacagacagcaacggtatgccatctaccggtacaacaacttatcacgtgagtggttcatcctctgcttcatctgacgtacctccagtctacactaccactgtaactagtggttctagtactgaaacggacgttgtttctgaatactctacaactgattcgaatggtatgccttccacaggtactacgacatatgaagtaactgacagttgccctgattgttctactggagctccgtcgcatagaagtaatgaggtcagctccatgccgtctagttttgctacctcatccatgagttctatttcccctgccacttccagtggtatgcctccagtctatactaccacagtcacatcgggatcatctactgaaactgatgtggtttctgaatacagtacgactgactccaatggaatgccgtctaccggtaccacaacgtatcacgtttctggctcaagttcagcctccagcgacgtcccaccggtctacacaactaccgtaacgtcaggttcttcaacagaaactgacgttgtatctgagtacagcactactgactcgaacggtatgccttcgacaggtacgtcttc

SEQ ID NO: 2488 - DNA, 681 bp, Artificial Sequence
  Description of Artificial Sequence: Synthetic polynucleotide
gaagacttaaggtacgtacccaccaggacaggccccccctggcacttatgctccaggacaaggtccacctggaacttaccctccaggacaaggaccacccggcacctatgcgccaggacaaggacctcctggaacttatccacctggccaaggtccaccaggaacgtatgctcctggacaaggtccaccgggcacctatccacctggacaaggacctccaggtacctatcctccaggacagggtcctgctggaacttacccaccaggtcagggtcctccgggcacttacccgccaggtcaagctccacctggaacctacccccctggacaaggtcctccgggtacttatttgcctggccaaggaccaccaggtacatatccacctggtcagggaccgccaggcacttatcagccaggagagggtgctcctggaacctatcagccgggtccaggtgcaccaggtacatacgcacctggtcagggtcctccaggaacttaccctcctgaacagggccctccaggtacttaccctcctggacagggtccggcaggtacttaccccccaggtcagggtccaccgggtacttatccacctggacaggcacctccgggtacctatcctcctggacaaggaccacctggtacttacttgcctggtcaaggtccaccaggtacgtcttc

SEQ ID NO: 2489 - DNA, 834 bp, Artificial Sequence
  Description of Artificial Sequence: Synthetic polynucleotide
gaagacttaaggtctgttgggtggataccctggattaggaggtttgtctagtttatacggaggatacccaggtctgttgggtggactgagcggtttaggtggacctcttggcttaggcagatatcctggattgtcaggactatatggaagatacggaactctgggttccttgagttcactgtatggtggctatcctggttacggtggactttccggtctattgggttcttatgctggtcttggaggcctatctaccctttatggtggttatccgggactgctaggtggtttgtcaggagtcggaggaccattcggtcttggccgttaccctggtctaagcggtctttacggacgatacggtactctgggatctctaagcacactttacggaggatatccaggatacggcggtttgtctggtttgctaggtggttatcctggattaggtggtttaagcggactgtacggcggttaccctggcgtcttaggaggtttaagcggtttaggaggtagattgggtcttttgggacgttaccctggactaagcggcctctatggtggttacggaactttgggaagcttatctactttgtacggtggatatccaggcttaaccggcgtatcctcgttgtacggtggttacagcggtgccctgggtggattgtctggattgggtggtccactaggagtcttaggccattacccaggattgtactcgtcaggtctgggcagccttggattattaggtccttacggttcatctcttggttactcagccctatacggatccagagtaggacctttcggtccatatggcacttcaggtacgtcttc

SEQ ID NO: 2490 - DNA, 840 bp, Artificial Sequence
  Description of Artificial Sequence: Synthetic polynucleotide
gaagacttaaggtttgtttggatcagtctatggacccattggacacttaggaccgtacggatctactcttggatactccggattgtatggatcgtctctaggaccatttggaacatactccacgtccggcctgttcggatcaggttacggtccttttggtcatttaggtccttatggatctaccttaggttattcaggtttatatggttctaggttgggaccgtttggaacatacggcacatcatctctttatggaagtggatatggtccattcggtcaccttggaccctatggttcaactctgggttactcaggcttgtatggaagcagattgggacctttcggcacttatggtacttctggtctttttggaagtggttacggaccatttggccacttgggtccatacggatccactttgggttattcaggagtgtacggttcgagattaggtccttttggaacttatggaacaagcggtttatttggaagtagttacggacctttcggtcatctcggcccatatggctctacgttgggatattcgggcctgtacggatcatctctgggaccgtttggtacatatagcacctctggcttatttggctccggatacggaccatttggtcatttgggaccttatggaagcacactaggatactctggtctatacggttctagactgggaccattcggtacatacggtacatcttcattgtacggttcgggatatggccctttcggacctctgggtccttacggttctaccttgggctattcaggtctatacggatccagtgttggaccattcggaacttacggaacttcaggtacgtcttc

SEQ ID NO: 2491 - DNA, 693 bp, Artificial Sequence
  Description of Artificial Sequence: Synthetic polynucleotide
gaagacttaaggtcagggttctccaggatctggtcagcctggttctggacacccgggcagtggtcaaccgggtagtggctcacctggtagtggacaaccaggatcaggatcccctggttccggacaaccgggtagcggttctcctggaagtggtcaaccaggttcaggcagtccaggttctggtcaacctggttattaccaaccaggatcacaaggccaacctggtaacggtcagcctggatcaggacagcccggctctggacaacctgagagtggacaacctggtaatggccaacctggttcaggccagcctggatcaggtgaacctggatctggtcaacctggatattatcgacctggtggtaagggacaaccaggaaacggacaaccaggatccggtcagcctggtagtggagaaccaggatcgggccaacctggttccggtcaaccaggctattacaggccgggaggtaagggtcagcctggtaatggtcaaccgggttctagtcaaccgggtagcggagaaccaggttcgggacaaccaggatctggtcaaccaggctactatcgtccaggtggcaagggtcaaccaggcaacggacagcctggatctggacaacctggtagcggagaacctggtagctcacagccaggttctggacagcctggatactatagaccaggtacgtcttc

SEQ ID NO: 2492 - DNA, 741 bp, Artificial Sequence
  Description of Artificial Sequence: Synthetic polynucleotide
gaagacttaaggtcaaggtatgaggccaggtcagggcatgggaccatcccaaggtatgggtcctggtcaaggtatgggacctggtcaaggaattggtcctggtcagggaatgggccctggtcaaggagtgggcccaggtcaaggcattggtccaggtcaaagtgtaagacctggccaaggcatgggtcctggacaaggtatgggtccaggccagggcgtaggtccgggtcaagagatgggacctggacaaggaattggtccaggacagggaatgcgccctggtcaaggtgtgggccccggacaaggtatgggccatggacaaggtatggaacctggtcaaggaatgggcccgggtcaaggcctaggtccaggacagggtgttggaccgggtcaaggaataggttccgagcaaggtatgggccctggccaaagcatgggtccaggacaaggaatgggtcctagacaaggaatgggcccaggtaaaggtttcggttctggacaaggtattggtccaggtcagtcaatgggtcccggacagggaatgggaccaggccaagatgttggacccggacagggaatcggttcaggacaaggcataggtccaggtcaaggaatcggtcgtggtcaagttcttggtcctggacaagttattgagccgggacagggtctaggacctggacagggtattggaccaagccagggtatgtcccctggccaactgatgggtccaggtacgtcttc

SEQ ID NO: 2493 - DNA, 633 bp, Artificial Sequence
  Description of Artificial Sequence: Synthetic polynucleotide
gaagacttaaggtgaaggtgaagaaggtgaagataaggacaacaccggagagggagaggaaggtgaggacaaagacaatactggtgagggtgaagaaggcgaagataaggataatactggagagggtgaagagggagaagataaagacaacaccggtgaaggagaagagggcgaggacaaggacaacaccggagaaggtgaagaaggcgaggataaagataacacaggtgaaggagaagaaggcgaggacaaagacaacactggtgaaggtgaagagggtgaagataaggataatacaggagagggtgaggagggtgaggataaggataacaccggtgagggtgaagaaggtgaggataaggacaacacaggtgaaggagaagagggtgaggacaaagataatacgggagaaggagaggagggagaagataaagataataccggtgaaggagaggaaggcgaggacaaggataacaccggcgagggagaagaaggtgaggacaaggataatacaggcgaaggcgaagaaggagaagataaggacaataccggtgagggtgaggagggtgaagataaagataacactggcgaaggagaagagggagaggacaaggataacacaggtacgtcttc

SEQ ID NO: 2494 - DNA, 588 bp, Artificial Sequence
  Description of Artificial Sequence: Synthetic polynucleotide
gaagacttaaggtgaaggtgaagaaggtgaggaaggtgaagataaggacaacacgggagagggagaagaaggcgaggagggcgaggataaggataacactggcgaaggtgaggagggtgaagagggagaggacaaggataacacaggcgaaggagaagagggagaggataaagataacactggcgagggtgaggagggtgaggacaaagataacactggtgaaggcgacgaaggtgaagataaagacaataccggagaaggagaagagggtgaagagggtgaagataaggacaataccggcgaaggagaagaaggagaagataaagacaacacaggcgaaggcgaggaaggtgaagaaggtgaagataaagataatactggagagggcgaggagggagaggagggcgaagataaggataacactggagaaggcgaggagggcgaagaaggtgaggacaaagacaatactggagaaggagaggagggagaagataaggacaacactggagaaggagaggaaggagaggataaagacaatactggcgagggcgaagagggagaggataaggataatacaggtacgtcttc

SEQ ID NO: 2495 - DNA, 384 bp, Artificial Sequence
  Description of Artificial Sequence: Synthetic polynucleotide
gaagacttaaggtcaacaaaaaaattctgagcagcaaaaaaacaacgaacaacagaagaactcagagcagcaaaagaacaatgaacagcagaagaattcggagcaacaaaagaactccgagcaacagaagaataatgagcaacagaagaataacgaacagcaaaagaacaacgagcagcagaagaataacgagcaacagaagaacaatgaacaacaaaagaataacgagcagcagaaaaacaatgagcaacaaaaaaataacgaacaacaaaagaactctgagcagcaaaagaataatgaacagcaaaagaacagcgaacagcaaaaaaataatgaacaacagaaaaataatgagcaacaaaagaacaatgaaggtacgtcttc

SEQ ID NO: 2496 - DNA, 1083 bp, Artificial Sequence
  Description of Artificial Sequence: Synthetic polynucleotide
gaagacttaaggtttgccaccaggtagtattcctccattgaggccaccaaatcaaggtggccatccacctggttcccagaagcctccgaacgtcggaatctacccgccatccactggttggatccctccttttggtcctcttacacaaggtggacacccacctggatctttattgcctcctaacacaggactaccaccaggttcgataccacctcttggaagcccgaaccagataggacatcctccaggctctcaaaaacccccaaatgttggtatctacccaccttcaactggatggactccaccatctggtcctttgacgcaaggaggacaccctccaggatctctgttgccacctaacactggattgccacctggatctatcccacctctgggctcccctaatcaaatcggacatcctccaggttcacaaaaaccaccgaacgtaggaatatatcccccatcaaccggttggattccaccttcaggtcctcttacccaatccggtcatccccctggtagtttgcttcctcctaatactggtttgccgccaggctctattcctccattacgtcctccaaatcagggaggacaccctcctggatctcagaagccgcctaacgtaggtatttacccgcctagcactggttggattcctccatccggacctcttacccaaggaggacatccaccaggtagccttttaccacctaataccggtttgccatcaggtagtataccaccattgggatccccaaatcaaattggtcatcctccaggctcgcaaaagccaccaaactcgggaatttatccaccaagtacgggtagtatccctccatcaggtcctcttactcagggtggacatccaccaggaagtctgttgccgcctaatactggccttccttctggcagtattccacctctcggttccccaaatcagattggtcacccgcctggatcacagaagcctccaaattccggtatctatccaccatctaccggttggattcctccttcgggaccattgactcagggcggacatcctcctggaagtctactaccgccaaacacaggtacgtcttc

SEQ ID NO: 2497 - DNA, 615 bp, Artificial Sequence
  Description of Artificial Sequence: Synthetic polynucleotide
gaagacttaaggtgcccagaagtggtgtgacaagacgtgtaaatgcaaatgcgagaaagaaatgccaactggtggatgtgagaataacaaaaaatggtgtgacgaaacttgtgattgcgtttgtcctcagaagaatacatgtattgctcctaaagtttgggacgccaaaacctgctcatgtatctgtgtaaatcctcctaagtgcaactcaccccaggttcttaaagacacatgttgctgtggttgtcaaaacgttaaaagttgcaaagctcctcaaaaattcatcgagaatatatgcgattgtgcctgtcccaataagaagcagtgcaaggcccctttagtttggtctgacgagttctgtgactgcgtctgcccaaactcggcgtccatgaaaacttgtttgtcgccaaaggaatggaacaaagtcacatgcacttgtgactgtaacccgccgaagccggactgttgtcctggtacacaaaagtggatggacgataagtgcaagtgcggttgccctaacgctcaaaccgattgtgctggaggtaagaaattcaacgactttacttgttcttgtggttgcccttctggtaagcttgactgcacaggtacgtcttc

SEQ ID NO: 2498 - DNA, 846 bp, Artificial Sequence
  Description of Artificial Sequence: Synthetic polynucleotide
gaagacttaaggtggaggcatgcaccatcagcatcaacagcatcaacaacaacaacaacatggaaagcatcatttgttattgcatcaccatcacacacacgatcaccaaaattctcataacaatggaaaccaccacgattcggaccatgaccacgttcaccatatgcaccatcatcttcagcaacatggtggtggagatgatgattcctcttctagcatgttggtgggttccttgttacaacaccatcaacatcaacaacaacagcatcaacagcagcaacatcaccatcaacaacaacaccatcatcagcaacagcatagtcctgttgatatctacgccgctgccgcagcagctgcacaccacaatcatcagcagcagcaacaacaccagcaacagcaacaacagcatcatagtcatcatcagcaacttcaattgcaacaacacttgaagtcatctgctgccgctgctgcagcagccgcagctgcagcagaatttgcagcttccaaccatcctttctcaataacgagacttcttccgccaccaccgactgcaagcgccgctgctgcagcctccgcttcagataagccttcgtctgccgcctctgtggctgctgccactgcttctagtgctacagctgcttcagctgctgaaaagatgtatgagatggctgccgcttcgcaatacggcactactgctggatataatgattattatcatcctcacgctcaccctcaccatcctcaccaccatggtcatccacatccacaccatcaacaagcatcactgtatcacgccgcagctgccgccgctgccgccgcggccgctgcagctgcaggtacgtcttc

SEQ ID NO: 2499 - DNA, 630 bp, Artificial Sequence
  Description of Artificial Sequence: Synthetic polynucleotide
gaagacttaaggtactacaggaggaggaggtgttacttatcctggaggtgcacccggaacgactacgggcggtggtacttatcctggtggcgttcacggtacaactactggtggtggtggtacttacccaggaggtgttccaggcacaacaacaggtggaggtggcggtacctaccccggtggagtgcctggtacaactacaggaggcggtggaacttaccctggaggtgtccctggcactaccaccggcggtggtggtacctacccaggtggaggcggaacttatcctggaggagtccctggcactgtaacaaccggtggcggaggtacttatcccggtggcgtgcctggtacggtaacaactggaggaggtggaacttacccaggtggagtcccaggaaccaccggaggtggtggtacctatcctggaggcatgccaggtactacaactggtggaggtgttacctatcctggtggtacaccaggtaccaggattgatggtggcgcagtttatccaccaggtattcctggtactacgactggaggaggaggaacgtacccaggaggaatccctggaaccactaccggcggaggtgtgacttatcctggtggagttccaggtacgtcttc

SEQ ID NO: 2500 - DNA, 537 bp, Artificial Sequence
  Description of Artificial Sequence: Synthetic polynucleotide
gaagacttaaggtggtggtacttaccctggtggtgtcccgggaacaactactggtggaggagttatctatccgggtggtgttccaggtacaacgaccggaggtggcacttatcccggtggagtcccaggaactacgactggtggaggtgttatttacccaggcggcgttcctggcactactaccggaggaggaacttacccaggtggtgtccctggaactacaacaggaggaggagtcatctaccctggaggagttccaggtacaactaccggaggaggtacctaccctggtggagttcctggtacaaccatcaccggtgacgccagagtatacgttggtactattccttcaggtggtgtcgttggaggagaagtctatccaggaaaagttccgggatctggagttgtatatcctggtggagttccagaccgcaccacctccggaggagtcatttatcctggaggtgtgccgggcaccactactggaggtggaacctatcctggaggtgctccaggcactacgacaggtacgtcttc

SEQ ID NO: 2501 - DNA, 561 bp, Artificial Sequence
  Description of Artificial Sequence: Synthetic polynucleotide
gaagacttaaggtcaaaactcagagcagtctaacgaaggtcagaactccgaacagtctaatgaggttcaatcgtcagagcattctaacgaaggacaaaacagcaaacagtccaacgaaggtcagaattctgaacagtctaatgaagtgcagtcgtctgaacactcaaatgaaggacagaattccgagcaatcaaatgaggttcaatcctctgaacacagtaatgaaggtcaaaattctaaacagtccaacgagggacaaaattccaagcaaagcaatgaagtgcagtccagtgaacattggaatgaaggtcagaattccaagcaatctaacgaggatcagaactctgagcagtcaaatgaaggccagaactctaagcagtctaatgagggtcaaaactctaagcaatcgaatgaagatcaaaactccgaacagagtaacgagggccaaaactctaagcagtccaacgaagttcaaagctctgaacagtcaaatgaaggtcaaaacagcaaacaatctaatgagggccagagttctgagcaatctaatgaaggtacgtcttc

SEQ ID NO: 2502 - DNA, 741 bp, Artificial Sequence
  Description of Artificial Sequence: Synthetic polynucleotide
gaagacttaaggttatggaagcactcaaactgctcgtgaaggatcaaatttgacggctggatacggttccactggtacggcaggatctgactcatccctcattgcaggatacggatcaactcagacctctggagaggactcctcattaactgcgggctacggaagtacacagactgcacaagagggctcaaatctgacagcaggatatggtagcaccggcacggcaggttcagattcttctttaatcgcaggctacggttctactcaaacttctggtggagattcttccctaacagctggttacggaagcactcaaacagcgcaagagggaagtaacttaactgcaggttacggaagtactggtaccgcaggatctgatagctcactcattgctggatacggaagtacccaaacaagcggtgaggattcatctttaaccgccggatacggttcgacgcaaaccgctcaggagggttccaacttaacagcaggttatggttcaacaggaaccgcgggatctgactcgtcattaatcgccggttatggatccactcagacgtctggtggtgactcttctctcaccgcaggttacggctcgactcagactgcccaagaaggttctaatttaactagtggatatggttcgacaggtaccgccggtgccgactctagtttgattgctggatatggttccactcaaacgtccggttctgattctgctcttacagcaggtacgtcttc

SEQ ID NO: 2503 - DNA, 633 bp, Artificial Sequence
  Description of Artificial Sequence: Synthetic polynucleotide
gaagacttaaggtagtggacgaatggctgactccggaggaatggccggtagtggcagaatggcagactccggtcgtatggccggttcaggacacatggcaggcagtggacatatggcaggcagtggccacatggcaggatcaggtagaatggctggatccggaagaatggccgactctggtggaatggctggttcttggagaatggccggttctggtagaatggccggatcaggaagaatggcaggaagcggtcgaatggctggttcctggcgtatggccggatccggtcgaatggcaggttccggaagaatggctggatctggtcatatggccggttctggtgatatggcaggttccggatgcatggccggttcgggaaggatggcaggttcaggtcatatggcaggctcaggaaggatggtcggatcgggacatatggttggatctggcagaatggcaggttccggtggcatggctggttcgggtagaatggctggttcatggcgtatggcaggttctggaagaatggctggaagcggacgcatggctggctccggtcacatggccggatcaggagatatggctggaagtggttgtatggctggatcgggaagaatggcaggtacgtcttc

SEQ ID NO: 2504 - DNA, 669 bp, Artificial Sequence
  Description of Artificial Sequence: Synthetic polynucleotide
gaagacttaaggtgtcccaccatctgccggtgttccaccatccgcaggagtaccaccatctgcggacgtacctccttcagctggtgttagtccaagcgctggtatcccaccttcagccggagcacccccaagtgctggtgttctaccgtccgcgggagttccgccgagcgccggagcacctctgtctgctggtgtgctgccaagtgctggtgtgccaccttctgctggtgtccctccatccgcaggagcaccaccttccgccggtgtacctccttccgccggtgtttctccttccgctggaattccacctagcgcaggagccccaccttcggctggagttctaccttcggcaggagttcctttatcagctggtgttccaccaagcgctggtattccaccttcagctggagccccaccatccgctggtgtgcctcctagcgctggagctccaccttccgctggtgttccgccgtcagcaggagtgcctccatcggcatctgtaccaccgtcagcggatgtacctccctctgcaggagtgtccccatccgcaggaataccaccatcagctggaatccctccctctgccggaattccccctagtgctggagctccaccgagtgccggtgcacctccttctgccggcgttccgccatcggcaggtacgtcttc

SEQ ID NO: 2505 - DNA, 906 bp, Artificial Sequence
  Description of Artificial Sequence: Synthetic polynucleotide
gaagacttaaggtgaggtctataactctgccaagaaaacatgctcatgcccagatggtcagtattggaacggtaaacaatgtgtttgtccatatggtcaagttttcaatggaaagcaatgtgttcctgattgtggcaaagaggcaactttcgattacaatcaaaagaaatgcgtctgcaagaataagggtgagatttacgatagtaagacaaaaacttgctcttgtcctgatggacaagtctggaatggcaaacaatgcgtatgtccgtatggacaagttttcaacggtaagcaatgtgtcccggattgtggcaaagacgccacatatgattataatcagaaaaagtgtgtctgcaaaaacaaaggagaagttttcgaccaaaaaactaagacttgctcctgtccagacggtcagtattggaatggtaagcagtgcgcatgtccgtacggacaaatttttaacggaaaacaatgcgttccagactgtggtaaagacgccacctatgattacaaccaaaaaaaatgcgtatgtaagaacaagggtgaggttttcgaccaaaagactaaaacttgtagttgccctgacggacaatattggaacggaaaacaatgtgtttgcccatatggcaaaattttcgacggtaaacagtgtgttgaagattgcggtaaagacgcacactttgacaacaaccaaaagaagtgcgtctgcaataaaaacggtgaaatatacgattcaaaatctaagacctgttcctgcccagattcccaatactgggacggttccaagtgcgcctgcccttatggtactgtctgggatggtaagcattgtaaccaggattgcggaaaggatgctcatttcgattccaaccagaagaagtgtgtttgcaacaaacaaggtacgtcttc

SEQ ID NO: 2506 - DNA, 741 bp, Artificial Sequence
  Description of Artificial Sequence: Synthetic polynucleotide
gaagacttaaggtttatggctatgtaaagcaaatactagattgagacgtcagaacggtcattgtcctccaggattgtggctgtgtaaggcaaatactcgactccgcagacagaacggacattgcccgcctggattatggctgtgtaaagctaatactaggcttagacgtcaaaatggtcattgtccaccaggcttgtggttatgcaaggctaacactcgtttgaggcgtcaaaacggacattgtccaccgggattgtggctttgcaaggctaatacaagacttagacgacaaaatggacattgcccacctggattgtggctgtgcaaggctaacaccaggctaagacgacaaaacggacactgtccaccaggtctttggctttgtaaggccaataccagattgagacgccaaaacggccactgtcctcctggcctctggttgtgcaaggccaatactcgtttaagaaggcaaaatggtcactgccctccaggtctgtggctgtgcaaagctaacactagactgcgtcgtcaaaacggtcattgtccacctggtttatggttatgtaaggccaacacaagattgagaaggcagaatggtcactgtccacctggcttgtggctatgtaaggctaatactagactaagacgtcaaaacggtcactgtcctccaggcctttggttatgtaaggctaacactaggttaaggcgacagaatggtcattgtcctccaggtacgtcttc

SEQ ID NO: 2507 - DNA, 651 bp, Artificial Sequence
  Description of Artificial Sequence: Synthetic polynucleotide
gaagacttaaggtccatggagatcggttggtggtagtttgggcccatggaggtctgttgaaggatccctaggaccatggagatctgttggaggatcgctgtccccatggagatcagctgaaggttcattgggaccttggcgatctgttggtggttcattgggtccgtggcgatcggttggcggaagccttggcccgtggcgatctgttgaaggttcactcggaccatggcgaagcgttggtggaagccttagtccatggagatctgccgagggttccttaggaccatggcgatccgtcggtggttcccttggaccatggagatcagtaggaggaagtttgggtccatggcgttctgtcggaggctcattgggaccatggagatcggcagagggttcgctcggtccatggagatcagttggaggtagtctgggcccatggagatccgtaggaggatccttgggtccttggaggtctgtgggaggtagcctaggtccctggagatctgtagagggatccttaggaccttggcgttcggtcggtggatccttgggaccttggaggagcgttggtggatctctcggaccatggaggtctgctgagggatccctcggaccttggcgtagtgtcggtggttctctaggtacgtcttc

SEQ ID NO: 2508 - DNA, 597 bp, Artificial Sequence
  Description of Artificial Sequence: Synthetic polynucleotide
gaagacttaaggtgaagaaagcgataacggagaagagtccgacaacgaggaggcttccgacaacggagaagcttcagataacggtgaagagtcagataatgaggaggcttcggacaacggtgaagagagtgacaacggtgaagagcgtggcaatggcgaagcttctgataatggagacgaatccgataatggagaggcgtctgacaatggagaagagtcagataacgaagaagcctctgataacggagaggaaagtgataacggtgaggaatctgataacggagaagaaagaggtaatggtgaagctagtgacaacggagatgaatccgataatggtgaagcttccgataatggtgaggaaagtgacaatgaagaggcctctgacaatggtgaagaatctgacaacggtgaagcatcagacaatggtgaggaatcagacaacgaagaggcttctgacaatggcgaagaatctgataatggtgaggcttcggataacggagaggagtctgacaacggcgaggaaagagataatggagaagcatcggataacggtgaagaatctgagaacggtgaagagattggtctaggtacgtcttc

SEQ ID NO: 2509 - DNA, 516 bp, Artificial Sequence
  Description of Artificial Sequence: Synthetic polynucleotide
gaagacttaaggtccattgagtgtggacccacaatctgtaggtcctctgtctgttggttcacaaagtgtaggaccacaaagtgttgatcctcagtccgttggtccgctaagtgtggatcctcaatctgttggtccattatctgtagaccctcagtctgtagatccacagtccgtcggaccactgtcggtcgaccctcaatctgtgggaccactatccgtagacccacagtctgtaggccctctttcagtcggacctcttagtgttgacccacagtcagtaggtccacagtcagttggtcctcaaagcgttggacctttaagtgtagatccgcagtctgttggaccgcaaagtgtcgatccacagtctgtaggtcccttgtctgtagacccgcagagcgtgggtccgttgtcagtgggtccactgagtgtggatcctcagtcagtcggccctcagtctgttggacctcaatccgttggaccattgtcggttgatccacaatctgtaggtacgtcttc

SEQ ID NO: 2510 - DNA, 789 bp, Artificial Sequence
  Description of Artificial Sequence: Synthetic polynucleotide
gaagacttaaggtagccctcaggctcaagagggcgccccaggtaggtcgtcagctcagggttctacgcaggcccgtgaaggtgcaccaggaagatcgtccgcaagaggatcacctcaggctcaagaaggcgctcctggtcgaagctctgctcaaggttcaactcaggccagagagggagcaccaggtaggagttccgctagaggctcacctcaagctcaagagggtgcccctggtcgatcgagtgcccagggtagcactcaagccagagaaggagcaccaggtagaagctctgcacgaggatccccacaagcccaggagggtgcacctggtagatcttcagctcaaggaagcactcaagcaagagaaggcgccccaggtagatcatcggccaggggttccccacaggcacaggagggtgctcctggtcgttcttctgcacaaggatcaacccaggctagggaaggtgcacctggaaggagtagtgctcgtggtagtcctcaagctcaggaaggtgctccgggtagatcctccgcacagggttcgacccaagcacgtgaaggtgcacctggtcgttccagtgctaggggaagtccacaggcgcaagaaggagctcctggcagatctagtgcccaaggttctactcaagctagagagggtgcaccaggtcgttcttctgctaggggttcaccacaagctcaggagggagcaccaggcagatcatcggcccaaggatcaacacaggcacgagagggagctcctggaagatcttctgccagaggtacgtcttc

SEQ ID NO: 2511 - DNA, 627 bp, Artificial Sequence
  Description of Artificial Sequence: Synthetic polynucleotide
gaagacttaaggtggaggtggtccaggaacacaatttccgggtggcgttgtatatcaacctggtacccaagttggcggtggtggtcctggaacgcaaccttccggaggagttttatatccgccaggaacgcaggttggaggtggtggtcctggtacacagttcccagatggtgtagtttaccaacccggaacccaagttggaggcggcggtcctggtgcccaactgccaggagccgtcctctatcctccaggaacccaagttataggaggcggaggacccggaacacaaacaccaggtggtgttgtctaccaaccaggaatccaagctggcggtggaggccctggtgcacaagcccctggaattgtctaccagcctggtacgcaagtcggcggcggacctggcgctcctggcggtattgtttatcaaccaggaaccaaaactgtgggaggcggtcctggtgctcaagctccaggtgtcgtctatcaacctggaacacaggttggtggtggccctggtgcacctggtggaattgtttaccaaccaggaactcagactggtggaggtggaccaggcgctcaagccccaggtttgatttatcaacctggaactcaggcaggtacgtcttc

SEQ ID NO: 2512 - DNA, 876 bp, Artificial Sequence
  Description of Artificial Sequence: Synthetic polynucleotide
gaagacttaaggtatgaacaggttcatgaacagatataggcctatgtttaacaatatgtattcgaacatgtacagaggtcgttatagaggaatgatggaacctatgtcgagaatgacaatggatttccaaggtcgctatatggattcacaaggacgtatggtggatccaagatattatgactattatggacgtttcaatgactatgacagatattatggaaggtcaatgtttaactacggatggatgatggacggagacagatacaatcgttacaacagatggatggattacccggaacgttacatggatatgtctggataccaaatggacatgtcgggtagatggatggatatgcaaggccgacattgcaacccttactctcagtggatgatgtataactacaaccgtcacggttattatccaaattattcctatggtagacacatgttctaccctgagaggtggatggatatgtcaaattacagcatggacatgtacggaagatatatggacaggtggggaagatattgtaaccctttcagtcagtacatgaactattacggtagatactggaattaccctggatacaacaactactactactcccgaaatatgtattacccagaaagatacttcgatatgtctaactggcaaatggacatgcaaggaaggtggatggacaaccaaggtagatactgtagtccatactggaataattggtatggtagacatatgtactatccttaccagaataactacttctatggccgatatgactaccctggaatggactacagtaactaccagatggatatgcagggccgatacatggaccaatacggaatgaacgattattattactcaggtacgtcttc

SEQ ID NO: 2513 - protein, 460 aa, Ceratitis capitata
GLQPSAGYQPGAGYQPGTGLQPGAGYQPGAGLQPGAGVQPGAGVQPGAGLPPSAGLQPGAGLQPGAGLQPGTGYQPGAGYQPGAGLQPGAGLQPGAGLQPGAGLQPGAGYHPGAGLQPGIGPQPGAGLQSGAGLQPGSGLQPGAGYQPGPGLQPGAGYQPSAGIRPDMGLQPGAGYKPGSGYQPGSSYQPGAGLHPGIQQGTGLHPGTGLQPRVGLQPGAGVQPGAEYQPGSGYQPDASLHPGAGLQPGGRLQPSAGLQPGTGLQPGVGVQPGAEYQPGSGYQPGAGLQPGAGLLPGGRLQPGAGLQPGTGLQPGAGYQPGSIYQPGAGYQPGAGLQPGAGVQPGTGYRPGAGLQPGGRLQPSAGLQPGAGLQPGAGVQPGAEYQPGSGYQPGAGLQPGTGIQPGAGLQPGVGLQPGAGLQPGAVLQPGTGYQPGAGYQPGTGLQAGAGLQPGAGLQPGS

SEQ ID NO: 2514 - protein, 362 aa, Archimantis monstrosa
GSPLEEKYDEKSEADDYQSEDSSAAIHDQTTKIATNAVKTYANKAKATESKAKLYHQYSKDRAYYSREYEKMGEEYMKKSKEYEQLYIAEAARISLHENKQKEWDTKGREANVGIREYETKSQQASSKKNELLEESIIAAVQAAIHETQATGYLLKSEAANGIARNMLQIAESIRDEASNHYQIGKEELNRATAQKVKAQQQAEDSQRHHAAARAYQQDSLRSRMASRANNMQYMQNSLLAERAHSLSTENTLESELYGKEADELAKMSEESAAISKICSGEERSYRNMAKQSEVKAYEYSVSKNMMGADMTDTAAMANGDEAKQGDDEEQQMYRSPNIPAEDSTKNLSYNLKDSTEGEGMS

SEQ ID NO: 2515 - protein, 351 aa, Archimantis monstrosa
GKKHEALTFGSGYKSTYGEGETFDDEDDQALRNERVPVGALSAAIINPYALHSEEGRIAYDTSSQYYANKAEGSADLSREKKQMHGEYHGKAATYASRANEAYKKSQLHKRQAKDKQAIAKEYEERAQKHESRSKALDVRDQDDERKSVTEMEEYARALKIANLALVFAGIYQETGRLQLEATNVFEQFHKMLSTKGEEYKKQAEEYKEKANKEKEEAAIQQAKSKELNAKAQEYENIFIESSKKLAANRYYELEFKMKAENERHHAELARIRSRFLSRLANYNREQAEAVLRFARSERKDGEIFRRNAIELYKETRALAATAARVMKQHRYTGQEIYTKQPFPHSNYHGA

SEQ ID NO: 2516 - protein, 364 aa, Pseudomantis albofimbriata
GSPLEEKYGEKYGDMEEYQRGTEDSRAVINDHTAKVASQSARGMVNKAKTTEAAARSNEQLSKDRQYYYREYLKKADYHKKKALEYEQLSAAENAKIAYHESKQKDWETKARESDVQCRDAEAKYEQSYTRSRELKRESIIAYVQAAMHHAEASGDHMKADRAKDIARDMMRKAESLRGDASNHYQRSEEDKNKARSEKVKAHQNADNSQRHHTACRAYDQEGLKTRLSSKANMMRQIHSSLLAERSHSLAREDGLAADLSHKLAEELARMSEESGAISKINSGEERGYSNKVRQDEVKAHELAVSKRMMGAEVADNSEMISLAQAKDGSLDEGENYKLSTFYADDSTKNMLPDSRGQMSYGDE

SEQ ID NO: 2517 - protein, 348 aa, Pseudomantis albofimbriata
GKNHEVMTYGSGYKTMGDEGGSGVGNEGEDYQDNEGATAATILDESTHHTEEARDIFGTRSEAHAYSAEMFADLVREKRQASIESHKKAEDYAVRANEESKKSQLLKRQARDKQAIAKQYEEKAQKYDRISKQQDIKEQDDYRKSDAESEEYKRSIAVANAALALASAYEEASRMELDATGEMEQQSKELYTKSEEYNKVAEECITRAKKEKELARIEEAKGKEAEAKSQEYENFATDNNKKYNAMKFYGWEFKMKAENERHNADYCRIKSRYLAQLSNYNREQAEALYHFAAAQRKDAELFHRYAMELYKQTRVLTASAAQIMKQHRYTGQEIYSKQPFPHSNYHGA

SEQ ID NO: 2518 - protein, 366 aa, Tenodera australasiae
GSPLEDKYDQKYEVEDYRGGSEDTKAAINDNAARVASHSAKSHVNKALVVEAAARLNAQIAKDRNYYAREYTKLAEESKKRARQYGQLADMEAGRIGQHEHMQQEWNSKARESEAQCKATEAKAQEEYTKARDERQKSLVSNAEAAMHDAQATVDTMKSERAYEIGKELMRKAENARNDASNHYQRAKENRERANSETVKSHQQAQDAQRHNAASKAYQQDGLRTRMASRINIMKYIQSSLLAERAANQARIEQLKSEWYEKAANEYSRMSEENAAISKLAGSEEHYFAQRAKRNEGKAYELSQSKRMMGSEAAAAGELLAMSQAKDDETEDEKHFDFPIYESDDPTKLSPSPDEKDLTYGSGEGL

SEQ ID NO: 2519 - protein, 342 aa, Tenodera australasiae
GKKHEVMTYGSGYKHMGGETYEDVGTGNRLGSTAFDIMEAADENTERASHTFGSKSAAYSSDADLFIELLREKRETRANHGKRAESQAVLANESYQKSQLHKRQAKDKQAISKEYEERAQKHDRLSKEQDMKEHDDYRKSNAEDTELRNSVERSNYDHVMALGYHELSQLEMGETNQCEQLSRELQSRAEEYFNLAKELKEKAKKEKENARIKKAKAKEEEARAEEYENAFTENSKKVLAYKFYELEFGMKALNEHHQAESARVRHHFLQILEQHNSQHADMLWGYAQQEDKDGRSFTQYATELSKQTKMLTATAAHLMKQHRYTGMEMYSKQPFPHSNYHG

SEQ ID NO: 2520 - protein, 250 aa, Hydropsyche angustipennis
GPRGWYGPRGLGPRGLGPLGLDSDIIGDGYGPYGLGSRGLGPLGLDSDIIGDGYGPRGLGPHGLGPRGLGPLGLDSDIIGDGYGPYGLGPRGLGPLGGLGRRPYGGYSASGSVSAEGPRGWYGPRGLGGIGGWRSRPYGGYSASHSVSVEAPVVYHAPIIRRAPKISRSSSYSVERIVTPTVITRISGSHSVSAEGRRGVWGPHGVWGPSGLYGDSGIVDGVYGPGLVGPGGWGRRPYGGYSASRSVSAE

SEQ ID NO: 2521 - protein, 280 aa, Hydropsyche angustipennis
GPRGWYGPRGLGPRGLGPLGLDSDIIGDGYGPYGLGSRGLGPLGLDSDIIGDGYGPRGLGPRGLGPLGLDSDIIGDGYGPYGLGPRGLGPLGGLGRRPYGGYSASGSVSAEGPRGWYGPRGLGGIGGWRSRPYGGYSASHSVSVEAPVVYHAPIIRRAPKISRSASYSVERIVRPTVITKIHKSVSHSVEQPIYYRPPVVVRAPKVSKSESYSVERIVTPTVITRIHHSASDSVEQPIYYRPPVVVRRPKISRSASYSVERIVTPTVITRISGSHSVSAE

SEQ ID NO: 2522 - protein, 128 aa, Hydropsyche angustipennis
GKIGHNAQKGIDDFLGGAHISKCGKHERILQGEDIIETNAKGELIEKIVSRKEILTDDDSESFSVSYSSEDDSTETIVKTITIVQEIPKHGKGKGHAKEKIFEEETVIKKIGKGVAAPVVAPAVDIVG

SEQ ID NO: 2523 - protein, 200 aa, Hydropsyche angustipennis
GRRGVYGPRGVWGPSGLYGDSGILDGVYGPGLVGPGGWGRRPYGGYSASSSVSAEGPRGWYGPRGLGPRRIGLGGYSASGSVSAEGPRGWYGPRGLGPRRIGSLGGYSASGSVSAEGIRGVLRPSPGIVVPGVISSGVVAPGLVGGHGGLVNVGGTHVLPGTSVYTTHPDPRTVRSSCRTSPYNLLIKVGNARKLNGNCS

SEQ ID NO: 2524 - protein, 257 aa, Hydropsyche sp.
GNRYYDLWNTCCQRPRYDGCGIFGNHLWDYVKYSASWSHSVENYDVGYHGFYWDDSWVHGVPHGNYYYPLWNYCCQHPRCNRCGIFGHHLQDYVKYSASWSTSVENYGYDVSYPGFYWDNSWVHGVPHGNHYYPLWNYCCQHPRCNRCGIFGHHLQDYIKYSASWSTSVENYGYDVGYPGFYWDDSWVHGVPHGNHYYPLWNYCCHHPRCNRCGIFGHHLQDYVKYSASWSTSVEDYGGYDYDFYWDDSWVHGVPHL

SEQ ID NO: 2525 - protein, 272 aa, Rhyacophila obliterata
GRGLGRGKHGWGGLGHGGLGGLGHGGLGGLGHGGLGGLGHGGLGGLGSDSGDLGGIGGLLGPGGRRGWGRRGPGKYSASVSISHSISIERVITPGVYTSIHRSVSVSHSVSVEHRRRIAPIVVDYSISSSLSISGEGRGLGRGKHGWGGLGHGGLGGLGHGGLGGLGHGGLGGLGHGGLGGLGSDSGDLGGIGGLLGPGGRRGWGRRGPGKYSASVSISHSISIERVITPGVYTSIHRSVSVSHSVSVEHRRRIAPIVVDYSISSSLSISGE

SEQ ID NO: 2526 - protein, 272 aa, Rhyacophila obliterata; identical to SEQ ID NO: 2525

SEQ ID NO: 2527 - protein, 218 aa, Rhyacophila obliterata
GRGLGRGKHGWGGLGHGGLGGLGHGGLGGLGHGGLGGLGHGGLGGLGSDSGDLGGIGGLLGPGGRRGWGRRGPGKYSASVSISHSISIERVITPGVYTSIHRSVSVSHSVSIERPRRIISPVVDYSLSISASSSVSAEGGRRRRLPGSCGTIISDSSSNVGGLGRIGALHKLGGGRIPRPAIYTRHPGLKGLKPQCPLSNFNVHVKVGNIRKANGNCG

SEQ ID NO: 2528 - protein, 256 aa, Rhyacophila obliterata
GSSVIDKLEDLLTHGHHGHHWEGTDGLHEKLLQEDDVIEANSKGEIIEKIISRREIITDDNSESESDSDSSEDSGSTEKIIKQIIIVQEKPKHGHHHAKEKIYEEEIIIKKIGDLPKKDCDENKPREVTSWRHTLPNRKSISISKSISIEQIIKPHVITRIRTSKSSSLSISVERPRRIISPIISGGWNRHKPRKYSASSSISKSISIERVITPAVWTRIHKSVSVSHSVSVEHRRRIAPIVVDYSISSSLSISGE

SEQ ID NO: 2529 - protein, 424 aa, Limnephilus decipiens
GRRRGPWGYGRGLSGSGDLDGLGGVGGLGGLGGLGGRRGPWGRGYGSSGTVSVSVSVEEGRRRGPWGRRGKVSISRSVSIERIVTPGVYTQISRSSSVSVEGGRRRGPWGRGYGPTGSVSVSVSVEGGRRRGPWGYGRRLGGLSGSGDLDGLGGVGGLGGLGGLGGRRGPWVRGYGSSVSVSVSVEGGRRRGPWGRRGKVSISRSGSIERIVTPGVYTKISRSSSVSVEGGRRRGPWGRGYGSSGSVSVSVEGGRRRGPWGRRGKVSISRSVSIERIVTPGIYTKISRSSSVSVEGGRRRGPWGYGRGLGGLSGSGDLDGLGGVGGLGGLGGLGGRRGPWGRGYGSSGSVSVSLSVEGVRRRGPWGRRGKVSISRSVSIERIVTPGSYSKISRSSSVSVEGGIRRGPWGRFGGFVSSGSSSVES

SEQ ID NO: 2530 - protein, 734 aa, Chironomus pallidivittatus
GPIANFVGFVISLLFSLFEVMVSVVFDVKSFTSLSTPTCNSTVPSFATRVGGGRFSGIITASFNMIAMISANVQAIQSGSGSTSGSSSSSTTSTSNSTTTTSNSTTTTTNSTTTTSNSTSSSNSTSSGLTSSASVVSLIDTIAWVYQDSSVGIAYLMVSILALFYGQSVSAPPYPDLGIPALPANCSGPGVPQSVQIRAAIAYVNITIYFINMTGQQFEDLQGPVATDCGCPNTTSVAPLVLEWEAILAALQALANSTASANSTTSSNSTTTTTTNSTSTTTTNSTTTTNSTSSSNSSTIAGCIDISANLTIALQNLQALLLQESTCAPALAANAKKSGVRDMSPCKPGKTASGCAKSGEKKVKRKARLEKMRAKCRRAVGNRMKGSMKKRVRSRAKKFGKAAKSGVRRYRKNIKYVYIPPVMASLNAYAALMASLSESISSQSDSALNSTDQACNSTGSNTDAAVIAATNNVTDMFANFTAMVLNNTVAYPNCTQFADMALLMISQINDQIISCGSQSDDAESSIYFNVTMNIVAMAQEYNNFASMSDKCTRSFANSWLWMYIKWVFYRMGMTSGIPNFLACQTKAESSLTAFLASFNATINATIAAASANSSSVQSSEASCIESSLSDASAILAMYENAYQNCVAPGSVPDAANTTTTSTTTTTTTTTTAAPTTTTTKAANAPFTYPLCNLQMTAACVAALPTCTYPFISSAGCCPSGKTLNTGLGGRGCCK

SEQ ID NO: 2531 - protein, 298 aa, Chironomus pallidivittatus
GCECGCAELNCPQNKKPNKETCECECKILAKCNDGQVFNKDTCSCNCPGSASDKVCKKPQIYNNESCKCGCPVDMQKPIDGCPRPQRWESDSCSCECPLKQDCKNGKVWDATICQCICPRDALPCAAGKERCGESCQCKCINREPKEGCSKSLVWNEDKCECVCPAGKQMPVGGCESGKSFNALTCQCECDESASKCGNKRWNADTCKCECQPGKPPEGCGKQTWISEKCKCECSPAITCEAPQILDPNTCECKCPVNMLAEKEKCKLPRQWTDSKCLCQCPTAPVTCEGKETWCGET

SEQ ID NO: 2532 - protein, 297 aa, Chironomus pallidivittatus
GCQCECKNKQEMANCKSPRTWNYDTCKCDCKNADDSDDCVKPQIWLDNQCKCGCPASAQMTCADNKRFIEKSCKCECKLAMPATIPPGKKWNEDKCVLECANVKTCEGPQRWCDNQCKCICPQVNTKCSDKQKFIESKCECGCDTQTQCKNGFRWSNLECGCLCDEKKCQGKQVFDKNTCQCKCPNQKPGDTCGNGKDFCPLDCSCKCKSPKPANGCPGVQEWNEEKCQCECPKDKPKKQCPGGQDWNNHLCQCGCPTPAPTCSNKQKYSNVSCSCGCKPGKPKEGRPGKQIWCENT

SEQ ID NO: 2533 - protein, 299 aa, Chironomus thummi
GCQCECPKPMPTEGCGPQSWNGESCKCECPSSITCSSPQIIDKDTCECKCPKNMLADKEKCTAPRQWIDSSCSCKCPTTPAVCEGNQKWCDESCQCTCPGGKKECGDNKYFDESSCECKCKSNPTCSDPQIWDADDCSCKCPKDKKMPKGGCLNGQEWNKLACSCGCPEPRPVCTDEQTYNNNTCKCGCGIDKPSCPKQQTYNWNKCQCGCPEEMKKPAGGCGAKTWLEEDCQCNCVPGKPAGGCLGAQKWCDDECICKCSNSEPAKGCGNKQWSDVSCDCECPTKKTCADPQVWDANT

SEQ ID NO: 2534 - protein, 286 aa, Artificial Sequence
  Description of Artificial Sequence: Synthetic polypeptide
GPYGDGLGPRGYSASASQSGEGGWGYGPYGGSLGPYGGSLGPRGYSASASRSVEGGWGYGPYGGGVGPYGGSLGPYGDGLGPYGSGVGPYGDGLGPYGGGVGPYGDGLGPYGGSLGPYGDGLGPYGGGVGPYGDGLGPYGGSLGPYGDGLGPRGYSASASQSGEGGWGYGPYGGSLGPYGGSLGPRGYSASASRSVEGGWGYGPYGGGVGPYGGSLGPYGDGLGPYGSGVGPYGDGLGPYGGGVGPYGDGLGPYGGSLGPYGDGLGPYGGGVGPYGDGLGPYGGSL

SEQ ID NO: 2535 - protein, 320 aa, Mallada signata
GSAGASSNGSVAGASKGAAGASSNGSSASASKGSAGASSGSSTATASKGSAGASSNGSSASATKGSAGASSGNSTAVASKGSAGASSNGSSASASKGSAGASSQGSSASATKGSAGATSNGSSAVASKGSAGASSGNSTASATKGSSSASSNGSSAGASKDGAGAASNGSTAVASKGSAGAASGNSTASATKGSSSASSNGSSATASKGSAGATSNGSSAVASKGSAGASSGNSTASASKGSAGASSNGSSATATKGSAGATSNGSSAVASKGSAGASSGNSTASASKGSAGASSNGSSATATKGSAGATSNGSSAVASK

SEQ ID NO: 2536 - protein, 159 aa, Mallada signata
GHPTDCGNSGGSSGSSAASGAASSSGSGSAAGSGAASGSGAASGSGAASGSGAASGSGAASGSGAASGSGAASGSGAASGSGAASGSGAASGSGAASGSGAASGSGAASGSGAASGSGSASGSGSASGSGSSSGSGSSGCGSGGSASGSSGGSSASASK

SEQ ID NO: 2537 - protein, 186 aa, Mallada signata
GSAGASSGNSTASASKGSAGASSNGSSATASKGSAGATSNGSSAVASKGSAGASSGNSTASASKGSAGASSDGSSASASKGSAGATSNGSSAVASKGSAGASSGNSTASASKGSAGASSGGSTAAASKGSASASSDGFSAACDSGESEAVDKANLAAIANIAAAAGKPAACGSAPPSDDYYDYGCG

SEQ ID NO: 2538 - protein, 256 aa, Mallada signata
GSSASASKNSAGASSNGSSAGASSGSAGASSGGSSASATKGSAGASSGGSSAGASSGSAGASSGGSSASATKGSAGASSGSSSAGASNGSAGASSGGSTASATKGSAGASSGGSTAGASNGSAGASSGGSSASATKESAGASSNGSSAGASNGSAGASSGGSSASATKNSAGASSGNSSAGASNGSASSSSGSSSSTATKESAGASSNGSTASASKDSAGASSGGSSAGATCSGAGAASGGSVSSATKNSSAASSQ

SEQ ID NO: 2539 - protein, 288 aa, Mallada signata
GSSGGATSSAGAGSASGSSGGSTSGASAGSASGSSGGSSSSAGSGSASGSSGDSSSSAGSGTASGSSGGATSSAGAGSASGSSGGSTSGASAGSASGSSGGSSSSAGSGSASGSSGDSSSSAGSGTASGSSGGATSSAGAGSASGSSGGSTSGASAGSASGSSGGSSSSAGSGSASGSSGDSSSSAGSGSASGSSGGSTSGASAGSASGSSGGSSSSAGSGSASGSSGDSSSSAGSGSASGSSCGSTSGASNGSASGSSGGSSSSAGSGSASGSSGDSSSSAGSGSAS

SEQ ID NO: 2540 - protein, 133 aa, Mallada signata
GQDSGCNVIAYPTASCGDSGSGSAASSGAASSSGSGSASGSGAASGSGSASGSGAASGSGSAAGSGAASGSGAASGSGSASGSGSASGSGSAAGSGAASGSGSASGSGSSSSGSSSSGSSGGCGGGSGSASSG

SEQ ID NO: 2541 - protein, 162 aa, Mallada signata
GSSGGSSSAAGSGSASGASGGATSAAGSGSASGSSGGSSSGASSGSASGSSGGCGSGGSSGSGSGSASGSGSASGSGSASGSGSASGSGAASGSGAASGSGAASGSGAASGSGAASGSGAASGSGAASGSAAASGAASSSGSASGSGSGSGSSDDSEDDSCG

SEQ ID NO: 2542 - protein, 210 aa, Mallada signata
GANGAAAASAAAAAARRAGAIGLNGAAGANVAVAGGKKGGAAGLNAGAGASLVSAAARRNGALGLNGAAGANLAAAGGKKGGAIGLNAGASANVGAAAAKKNGAIGLNSAASANAAAAAAKKGGAIGLNAGASANAAAAAAKKSGAVGLNAGASANAAAAAAKKSGAVAANSAASANAAAAAQKKAAADAANAAASESAAAAAAKKAAAV

SEQ ID NO: 2543 - protein, 200 aa, Haploembia solieri
GSASGSASGSKSESGSASGSASGSKSESGSASGSESGSAQGGGSKSESGSSSGSASGSKSESGSASGSASGSKSESGSASGSGSGSKSESGSASGSASGSKSESGSASGSASGSKSESGSASGSESGSAQGGGSKSESGSSSGSASGSKSESGSASGSASGSKSESGSASGSGSGSKSESGSASGSESGSAAGGGSKSES

SEQ ID NO: 2544 - protein, 266 aa, Artificial Sequence
  Description of Artificial Sequence: Synthetic polypeptide
GAVYLRLSSDGSCPADQVCCREEDSNEICGGTCVPEGACEAGGINLRVGGAGGGCSFGEICCDLPLNRCRGTCTTVDLCGDNRRVDLRFEDQLCPGSQVCCEKSKTNAICHGRCVAANECSRSSNLVDLRVQSNDGCPGDRICCQNTCEGQCVPRGQCGDDTKDIDLRVGDSSCPENQVCCKNPRTCTCVDPSKCPQMINLRFSSECPFHQVCCDSVSDSNCQGLCTPDDQCKVRSNGTCSGGLTCCGKIKPSCDGSCVSLGQCPT

SEQ ID NO: 2545 - protein, 258 aa, Artificial Sequence
  Description of Artificial Sequence: Synthetic polypeptide
GCPANQQDPFAVCCRNASKLCNGSCVSQEQCADSGFDLRISSQTCPGNAVCCKNLSKSPTGKVCQGRCVPSQQCTGQSQNSVDLRFSEGLCPLNLVCCPASTSCSGSCVAGNRCLDNALSINLRRSTESCPAGLVCCQNVNKGSTCDGQCTSRDRCADLTLGINLRLSDQSCPSNQICCKKVRKPLPDAECTCVMLDQCADDQRSIDLRTGGQKCPSRKICCTKLKTTVEKCDGSCISYQDCPEIANASSVDLRLFSG

SEQ ID NO: 2546 - protein, 377 aa, Oecophylla smaragdina
GVPKELGTSISSASASASASASATASSSSKNVHLLPLKSEHGIVIDKSKFNIRKVVLSAIDEINGAPNIGLGLKQVSLALAKAQASAQSSAEALAIIKKIVALLISAYVRAAEAAARASAEALATVRAAEQAQKIAEAKGRAAAEALSELVEASQKADAAAAGTTDAIERTYQDARAATSAQTKASGEAENANRNAAATLAAVLSIAKAASGQGGTRAAVDAAAAAAAAAALHAKANAVSQATSKAAAEARVAAEEAASAQASASASAQLTAQLEEKVSADQQAASASTDTSAAIAEAEAAALASTVNAINDGVVIGLGNTASSSAQASAQASALARAKNARPKIKGWYKIGGATSASASASASASAQSSSQGLVYS

SEQ ID NO: 2547 - protein, 373 aa, Oecophylla smaragdina
GSKSYLLGSSASASASASASASAGGSTGGVGVGSVISGGNNIIRGASTTSVTLAAAAAEAKAALNAGKATVEEQREALQLLTASAEKNAEARSLADDAAVLVQGAAEAQSVAAAKTVAVEQGSNSLDAAAAEAEAAAAASRVSAQQALQAAQTSAAAIQTAAGSALTALKLARKQEAESNNAAEQANKALALSRAASAATQRAVAAQNAAAASAASAGAAQAEARNAYAKAKAAIAALTAAQRNYAAAKASASAGSVVAEQDAQSRAADAEVNAVAQAAARASVRNQEIVEIGAEFGNASGGVISTGTRSSGGKGVSVTAGAQASASASATSSSSSSSGINKGHPRWGHNWGLGSSEASANAEAESSASSYSS

SEQ ID NO: 2548 - protein, 425 aa, Oecophylla smaragdina
GSELVGSDASATASAEASASSSAYGSKYGIGSGAVSGASASASASASASASASSAPAIEGVNVGTGVSNTASASAEALSRGLGIGQAAAEAQAAAAGQAAIAAKSCALAAKSTAQAVALVEKVARAEVDLAESARKATRLSAEAAKAAAEVEKDLVGLRGAAGKLNLAARAGSKAQERANEDSIEANELAQATAAAGAEAEAKANAAQEAGASALAIAQAALNIEQETVKLTRQAQNTRLRSENILAAASNARAIASAEAEASSDLNNRANAARSNARAAAETRAVATEAASTAEIAAYSSSEKGEITNPGPLPKIVSVTAGLTQNEIAGSGAAASASASALASASAGAGAGAGAGAGASAGAGAVAGAGAGAGAGASAGASAGANAGAGASSLLLPQSKLHPISRSSASASASAEAEANSSAYA

SEQ ID NO: 2549 - protein, 381 aa, Oecophylla smaragdina
GVIGPDTSSSSQASASASASASASASSSASIGYNELHKSINAPALAVGVKNGGVDVAKGAAVVESAISDVSTLTDDRTLNGLAIIGNSAESLARAQASSSASAGAKANALIKQSIAAIEITEKAEYLASIVATKAAKAAEATAAATARATAVAEAAKVSSEQFAAEARAAADAEAKANAASIIANKANAVLAEAATGLSASAGKAQQSATRALQAARAAAKAQAELTQKAAQILVLIAEAKAAVSRASADQSVCTSQAQAASQIQSRASAAESAASAQSEANTIAAEAVARADAEAASQAQAWAESFKRELSSVVLEAEANASASASAGALASGSSSSGASSSADASAGASSYGSLGGYRHGGSFSEASAAASAASRAEAA

SEQ ID NO: 2550 - protein, 377 aa, Myrmecia forficata
GNLLKESKASASASASASARASGKKNLHVLPLPKKSEHGIVIDKSVFDIKDVVLSAVDEINGAPKLGLGWKKVSMGVERAEANAAAAAEALAMIKKIAMARSSAYVQAAWASAQASADALASARVAQASQEAAEAKGRAASEALSRAIEASSRADAAAAATLDAMDRTMENARAANAAQTQASGQAENANRSAAAILAALLRIAEASALNNEAAVNAAAAAAAASALQAKANAASQATARAAGQASTAAEEAQSAQEAADKNAELTTVMLEKASADQQAASARADYYTASTEAEAAAQASAINALRDGIVVGMGNDAGASAQAMAQVEALARASEHKALGEKKKGLVWGYGSKGSSSASASASASAEASSRLGKDWG

SEQ ID NO: 2551 - protein, 404 aa, Myrmecia forficata
GSGPRLLGGRSAASASASASAEASAGGWRKSGASASASAKAGSSNILSRVGASRAAATLVASAAVEAKAGLRAGKATAEEQREALEMLTLSADKNAEARILADDTAVLVQGSAEAQSVAAAKTVAVEEESASLDAAAVEAEVAAATSKSSAGQALQSAQTAASALRTSARSALTALKLARLQGAASSNAARMMEKALAATQDANAAAQQAMAAESAAAEAAAIAAAKQSEARDAGAEAKAAMAALITAQRNLVQANARAEMASEEAELDSKSRASDAKVNAVARAASKSSIRRDELIEIGAEFGKASGEVISTGTRSNGGQDAIATAEASSSASAVGIKKTSGHWGSGKWSRVSKGKGWASSNADADASSSSIIIGGLKRGGLGSEASAAASAEAEASAGTLLL

SEQ ID NO: 2552 - protein, 424 aa, Myrmecia forficata
GSELESEASAAASAQAEASSSGRSGKLSASQASASASASASAGSRGGSKGGWGQLRRGDVKSEAKSAAAIAVEGAKIGTGIGNTASASAEALSRGLGIGQAAAEAQAAAAGQAEVAAKSCELADKTTAKAVAMVEAAAEAEIEVANQEVAAVKLSTWAAKAARIVEEDSAAVRAAAGKLLLAARAAAAAERRANEESEAANELAQASSAAAAEAEAKANAGREAAAAALAIAEAAVAIEQEAVILARKAQDARLNAEAAAAAAMNARVIASAESEASEDLENRASVARASAAGAAEAKAIATDAGATAEIAAYSWAKKGELINPGPLPKIISVNADLSKSEVEAMKITRGQVQEVKKISTHKGGWGWGKEGRSKVSSNASARASASANAAAGSLGSKWGRQLSASSASADANAEADSQLLKVWG

SEQ ID NO: 2553 - protein, 393 aa, Myrmecia forficata
GRVIESSSSASAQASASAGSRGLLGKRPIGKLEWGKEEKKLEELDEESLNEAALKVGIKNGGLDVAKGAAVLEAAMSDVATLTDQRSLVDLGLGPVANEAEILAEAQAATSAQAGAVANSAAERAIAAMEMADRTEYIAALVTTKAAKAAEATMAATARATAAASASKISSQESAASAANAANAEAKANAASIIANKANAVLAEAAAVLAATAAKAKESAMKSLSAAQAAAKAQARNAEASAEAQIKLSQARAAVARAAADQAVCSSQAQAASQIQSRASASESAASAQSETNTAAAEAVATADAEAAAQAEAWVMSLKNDLWLHLNMKGEAKAEGEAVSISKGHRGGIRSGSISEASAEASSNVSMGGRHGRKDLVSEALAGASAGSSADSL

SEQ ID NO: 2554 - protein, 313 aa, Bombus terrestris
GSVELGAPKQESVLVEQLLLKNVETSAKRKENGAPKLGESTAAALASTKATAAAEAKASAKVKASALALAEAFLRASAAFAAASAKAAAAVKEATQAQLLAQEKALIALKTQSEQQAASARADAAAAAAVSALERAQASSRAATTAQDISSDLEKRVATSAAAEAGATLRAEQSAAQSKWSAALAAQTAAAAAAIEAKATASSESTAAATSKAAVLTADTSSAEAAAAAEAQSASRIAGTAATEGSANWASENSRTAQLEASASAKATAAAAVGDGAIIGLARDASAAAQAAAEVKALAEASASLGASEKDKK

SEQ ID NO: 2555 - protein, 308 aa, Bombus terrestris
GQSSPLLEIVQGSASATASTAVTARSGLRAGQVAVASQKDATLQADASAAAAAAARASADQSASLAQQSASLQSKAAARAKSAEESAAATAKAELQAESIAASASSNAREAAASAKASASAMSSAAVQAKLAEKTAKNQALASEEAKLKAAAAASAAAAASAAAEAALKAERIAEEAIAKAAAAKAAARAAAAALNSAKEAATSSARSAAEAEAKSEVAILISELDKKSREVAASASAKARAAAAASSRNAETAVIGANINVAKEVLAIPIEPKKLPEPELALKEENVAVASSESEVKVETSSEAWSI

SEQ ID NO: 2556 - protein, 338 aa, Bombus terrestris
GKPLIANAQIGKVKTETSSSSEIETLVSGSQTLVAGSETLASESEALASKSEALTSEAEIASVTTKDELILKGEAITGKKLGTGASEVAAASGEAIATTLGAGQAAAEAQAAAAAQAKSAAAAAANAGESSNSAAALVAAAAAAQGKAAAAAAAATKASLEAADAAEEAESAVALARAASAKAEALASTAAAANTRAALQAEKSNELAQAEAAAAAEAQAKAAAAAKATQLALKVAETAVKTEADAAAAAVAAAKARAVADAAASRATAVNAIAEAEERDSAQAENTAGVAQAALAAAEAQDSCIGAAATPRHSSSYAWWKLRITSLIVILSPRNRRT

SEQ ID NO: 2557 - protein, 295 aa, Bombus terrestris
GHVVKRDKELKAPALPELLGDGSDTLGASMENGIKVARASQNVGLRTELNAAARAAAAAATKQAKDTEAAEAGAAAAIAIAIAKREEAIKASELASKLLTAAAGSSEAAVSATVRAAQLTAAASAAAKASASASEASAEAQVRANAEANIAKKASAAEAKAAAEAQVKAELAKKAAAGFLAKARLAASAESEATKLAAEAEVALAKARVAVDQSQSAQATATAQAATAVQLQSQAANAEASAVAQAETLLVTAEAVSAAEAEAATKATSWGEECHQREKVTFSEDRLNERQDNWG

SEQ ID NO: 2558 - protein, 488 aa, Bombus terrestris
GDRSWAASDANAEASAAVESPSLWEDSSSASAGASNAAESSSLWEDSSSENTGASTAAESSSLWEDSSSASARASTAAGSSSAWEDSSITNARESGASGSLSSWEDSSSASASSSTSASASSSSSSSSSISSSASSSSSASASASTEASNESRRGIAIEGALVGTGAASTAAASAEMLSDTLGLGQSALQAQTASVTQANIASDASNQANRLAAAAAAAMSAAASAQENAASLARASASASESAASASSKAEASAEAAKSSAEKCLLLAQNSAQAQARATEQSESSNRDSAANAAAAAEAERKATLALKAIADAKAKAGVAVAAQSEAAAAAAAAAKARADAEAGANLAAAARAVAAAEAAASRRNDRQAGIAQAGASAAAETRALASSAAATAKAAAYANADIRALSAAALESSISSSSSTSASSASSSASSGASSDSSSGASSGASSDSSSNSSSDSSSLLGDDASTSASSTAEAESRTSSLILNG

SEQ ID NO: 2559 - protein, 324 aa, Vespa simillima
GKRARRSSNAEASAATSTSSQADSGKNKDACASDAIAGAAASASSQASILGKRARRSSNAEASAATSTSSQADSGKNKDACASDAIAGAAASASSQADSGKNKDACASDAIAGAAASASSQASSLGKRVRRSSNAEASAATSTSSQADSGKNTDASASDAIVSVAASVSSQADSGKGKSAGESNAEASAAASASSQADSGKGKSASESNAEASAAASTSSQADRGKDKDASASNAEASAIASTSSQAGSGKGKSTSESNAETSAAASASSQANTGKDKSTSDSNAEASAAASASSQADRGKGKDASESNAAAWAASASSQSDNS

SEQ ID NO: 2560 - protein, 160 aa, Vespa simillima
GASNAAESSSLWEDSSSENTGASTAAESSSLWEDSSSASARASTAAGSSSAWEDSSITNARESGASGSLSSWEDSSSASAGASNAAESSSLWEDSSSENTGASTAAESSSLWEDSSSASARASTAAGSSSAWEDSSITNARESGASGSLSSWEDSSSASA

SEQ ID NO: 2561 - protein, 279 aa, Vespa simillima
GIAIEGALVGTGAASTAAASAEMLSDTLGLGQSALQAQTASVTQANIASDASNQANRLAAAAAAAMSAAASAQENAASLARASASASESAASASSKAEASAEAAKSSAEKCLLLAQNSAQAQARATEQSESSNRDSAANAAAAAEAERKATLALKAIADAKAKAGVAVAAQSEAAAAAAAAAKARADAEAGANLAAAARAVAAAEAAASRRNDRQAGIAQAGASAAAETRALASSAAATAKAAAYANADIRALSAAALESSISSSSSTSASSASSSASS

SEQ ID NO: 2562 - protein, 355 aa, Vespa simillima
GSSSSSAESSASATASSDASWSASSRSSATGRAPNVILNRAPQLGASAAAIASARASTSANAASDEKSARETRATALARSRAAVTAAARAAARTQEAVAAAKAASRAQALAAAKSSAAISALAAGEAAAQKADAAALAALAANQRSVKAAENGLAVQNRANGEAEQASRAAAANLAAAIRTRDNALETRREAARLKALATAAANANNKATSLAEASANQAAEASSAAEDTSSAQSAAVAQAEAAETLNVNLAILESTQSSRQDSNVAKAEASAAAKASPGTATRDGVNLGLASDAGAAAQLKAQAAALARASSRISSGPALSAWKWRNEDSSESSTSAIASSSASSSSSSRSASG

SEQ ID NO: 2563 - protein, 459 aa, Vespa simillima
GAESSSSSSAASSASSSSSESRGQLLLPLERSSTRSLLDLVSSARSNTAITASSAAAAKATLRAIKAANSAQGEALAQATASAASNAKARATAAAAAQATNAAVNAQGKASAQAIATAEAAEALTKSALQAQSAASSSKSEAAQASTSANAGAGALATASAQALSAKKAALAYASAAADASTAAAKARAAVAAAEAATRTAVQAERDSTNAASLAAKAQAEARAAAAAAAAARLAASAAADASAQADARVRTASIEAAASARTKASNAQATAEAAAIARSSSRDAQANWVDNRSSASSSSASASASVSASASGEADSEADSDASASARSAADSNAGSSSGLAADSAADTAAGSTAGSAARLSAGSAAGSIARSAAGSTAGSSTGSGAGASAEGSSNASSGTSAGASSGASTGASAGASATASADNSADNSAEALSSSSAESSSSSWSSSSQNIWSQDWG

SEQ ID NO: 2564 - protein, 354 aa, Vespa simillima
GPSRLSETSDSSAASWSSSSSSSSSLSSSLASDSASSSASGSASASASASASASASSRNDNSRVKAWKKGRGGSDSLVLSSDSSEDSKARELLETDAGLGAAAALARATADAQARTAASADATANKATAKALVLAEAAVRAENAAIVRIRRALSAAQALVSASNRAKAAARAAREAAANSAAAAAKASTNQVKANADSLVANRAAAALLAAAEEALQKASASQNAAAEAAAKARAAANANAATTRAAASAILAEARARTAITKALAAQSTASAQASSASQVQNRANNLQAETASLAQSRAEAAIAAAAAQAAALAEANAQLARLSKASAGASSEGSASASASASASASSSSSSA

SEQ ID NO: 2565 - protein, 324 aa, Apis mellifera
GAREEVETRDKTKTSTVVKSEKVEVVAPAKDELKLTSEPIFGRRVGTGASEVASSSGEAIAISLGAGQSAAESQALAASQSKTAANAAIGASELTNKVAALVAGATGAQARATAASSSALKASLATEEAAEEAEAAVADAKAAAEKAESLAKNLASASARAALSSERANELAQAESAAAAEAQAKTAAAAKAAEIALKVAEIAVKAEADAAAAAVAAAKARAVADAAAARAAAVNAIAKAEEEASAQAENAAGVLQAAASAAAESRAAAAAAAATSEAAAEAGPLAGEMKPPHWKWERIPVKKEEWKTSTKEEWKTTNEEWEVK

SEQ ID NO: 2566 - protein, 291 aa, Apis mellifera
GRVINHESLKTSEDIQGGYSAGIVGDGSDALGSSIENAQKVARAAENVGLNLELGAGARAASVAAAAQAKNTEAAEAGANAALAAAIAKREEAIKASEIANQLLTNAAKAAEATVSATKRAAQLTAAAKEATRASAAAAEAATEAQVKANADSIITKRAAIAEAQAAAEAQVKAAIARKSAANFLAKAQIAAAAESEATKLAAEAVVALTNAEVAVNQARNAQANASTQASMAVRVDSQAANAEAAAVAQAETLLVTAEAVAAAEAEVANKAATFAKQIVNEKKIHVAKLE

SEQ ID NO: 2567 - protein, 317 aa, Apis mellifera
GVEEFKSSATEEVISKNLEVDLLKNVDTSAKRRENGAPVLGKNTLQSLEKIKTSASVNAKAAAVVKASALALAEAYLRASALSAAASAKAAAALKNAQQAQLNAQEKSLAALKAQSEEEAASARANAATAATQSALERAQASSRLATVAQNVASDLQKRTSTKAAAEAAATLRQLQDAERTKWSANAALEVSAAAAAAETKTTASSEAANAAAKKAAAIASDADGAERSASTEAQSAAKIESVAAAEGSANSASEDSRAAQLEASTAARANVAAAVGDGAIIGLGEEAGAAAQLLAQAKALAEVSSKSENIEDKKFS

SEQ ID NO: 2568 - protein, 315 aa, Apis mellifera
GLEGPGNSLPELVKGSASATASTAVTARSGLRAGQVALASQKDAVLQAQAAASAASEARAAADLTAKLSQESASVQSQAAAKGKETEEAAVGQARAGLESVSMAASATSAAKEASTAAKAAASALSTAVVQAKIAERAAKAEAVASDEAKAKAIAAANLAAEASVAAEAALKAEKVAEEAIARAASAKAAARAAAAALASSKEAATASARNAAESEARNEVAVLIAEIDKKSREIDAASSLNARAAAKASSRNVETATIGANINSSKQVVSIPVEIKKFSEPEVSTSWREDEEVTKEKKEHINLNDFDLKSNVFS

SEQ ID NO: 2569 - protein, 224 aa, Artificial Sequence
  Description of Artificial Sequence: Synthetic polypeptide
GANANSDSNSNSNSNANSDANSNSYSNSGANANSNSNSNSNSNANSDANSNSYSNSGANANSNSNSNSNSNAYSDANSNSYSNSGANANSYSNSNSNSNANSDANSNSYSNSGANGNSNSNSNSNSNANSDANSNSYSNSGSNADSNANSDSNSNANSDANSNSYSNSGAYANSNANSNSNSNANSDANSNSYSNSGANANSNSNSNSNSNANSDANSNSYSNS

SEQ ID NO: 2570 - protein, 234 aa, Aposthonia gurneyi
GDGSGSGSGSGSGSGSGSGSGSGSGSGSGSGSDSGSGSGSGHGSSSSSSSGDGSGSGSGSGSGSGSGSGSGSGSGSGSGSGSGSGHGSSSSSSSGDGSGSGSGSGSGSGSGSGSGSGSGSGSDSGSGSGSGHGSSSSSSSGDGSGSGSGSGSGSGSGSGSGSGSGSGSGSGSGSGHGSSSSSSSGDGSGSGSGSGSGSGSGSGSGSGSGSGSGSGSDSGSGSGSGNGSSSSSSS

SEQ ID NO: 2571 - protein, 182 aa, Artificial Sequence
  Description of Artificial Sequence: Synthetic polypeptide
GNNLNAQNMAAGSNTQITAGNVIGSAIQNTAAGLAASANIINNGVNRIVTNSNTKGLVNTISRINNLNGRNNGALGLNGNNLQGQVPLVNGVNQAVTNSNTQGLVNTISQINNLNGGNNGALGVNGNNLQGQVPLVNGVNQAVTNSNTQGLVNTISQINNLNGGNNGALGVNGNNLQGQVPL

SEQ ID NO: 2572 - protein, 180 aa, Hilara sp.
GNNLNAQNMAAGSNTQITAGNVIGSAIQNTAAGLAASANIINNGVNRIVTNSNTKGLVNTISRINNLNGRNNGALGLNGNNLQGQVPLVNGVNQAVTNSNTQGLVNTISQINNLNGGNNGALGVNGNNLQGQLPLVNGVNQAVTNSNTQGVVNTNSQISNLNGANNVALGVNGNNLQEAL

SEQ ID NO: 2573 - protein, 182 aa, Hilara sp.
GNSLNAQNMAAGSNTQITAGNVIGSAIQNTAAGLAASANIINNGVNRIVTNSNTKGLVNTISRINNLNGGNNGAVGLNGNNLQGQVPLVNGVNQAVTNSNTQGLVNTISQINNLNGGNNGALGVNGNNLQGQVPLVNGVNQAVTNSNTQGLVNTISQINKLNGGNNGALGVNVNNLQGQVPL

SEQ ID NO: 2574 - protein, 406 aa, Apotrechus illawarra
GRPSGDDDVRIISSTKDVTSTGKRRSNSKNNVAQSSSQKDSIRVKDSNEVIKSISENDPDGTRITTSKGTGVGSETLNENLVELNQNTVSDTNSVETSSDKSNSVTTYDADDRPLTVTDRKGQKDVKSATNAKEDSSEVSENSESETNWQSESDSVEKSVSHPVCGGAESPSSGGPQGSGPQGGGSQGGPSGQGQPNGGIAVSSAEDAAAPQSTRTSTAEGESSSFSAAADVNEGSRKGNVALAGSTAYGRSVTNENSSSGSTQSFSGAAEENVASPDGGSTQRNAAIAGNIAEGQVSSKEEVAEGKATSLSGTIQESDENSQRSAAIAGSSAEANVATREQTSKGKTAAWTGNSQEKSTSPAEISETNIFSSGSYAEGSTLSREKLEQGKSTTWSEESEESRKHG

SEQ ID NO: 2575 - protein, 190 aa, Apotrechus illawarra
GAVAGGVAGASSKASGNEGSGAASGAKTVSVAGTDGSGGALAGSAAGAISKASGDEGSGAASGAKTVSVAGTDGSEGAVAVGVAGASSKASGNEGSGAASGAKTVSVAGTDGSGGAHAGSAAGASSKASGDEGSGAASGAKTVSVAGTDGSGGALAGGAAGASSEASGDEGSGAASGAKAVSVAGTDGSG

SEQ ID NO: 2576 - protein, 141 aa, Cricula trifenestrata
GSSGRGLGGYDGSVDGGYGSGSGSAAAAAAAAAAGSSGRGIGGYDGFVDGGYGSGSGSAAAAAAAAAAAAGSSGTGFGGYDGFGDGGYGSGSSAAAAAAAAAAAAGSSGRGLGGYDGWVDDGYGSGSGSAAAAAAAAAAAA

SEQ ID NO: 2577 - protein, 142 aa, Antheraea yamamai
GNNLHHHDEYVDNHGQLVERFTTRKHYERNAATRPHLSGNERLVETIVLEEDPYGHEDIYEEDVVINRVPGASSSAAAASSASAGSGQTIIVERQASHGAGGAAGAAAGAAAGSSARGGSGFYETHDSYSSYGSGSSSAAAA

SEQ ID NO: 2578 - protein, 134 aa, Antheraea yamamai
GSGAGGVGGGYGGGDGGYGSGSSAAAAAAAAAAAASRRAGHDRAYGAGSAAAAAAAAAAGAGASRPVGIYGTDDGFVLDGGYDSEGSAAAAAAAAAAAASSSGRSTEGHPLLSICCRPCSHRHSYEASRISVHG

SEQ ID NO: 2579 - protein, 186 aa, Antheraea yamamai
GSGAGRAGGDYGWGDGGYGSDSAAAAAAAAAAASGAGGSGGGYGWGDGGYGSDSAAAAAAAAAAASGAGGSGGGYGWGDGGYGSDSAAAAAAAAAAAAGSGAGGRGDGGYGSGSSAAAAAAAAAAAAARQAGHERAAGSAAAAAAAAAAAAASGAGGSGRGYGWGDGGYGSDSAAAAAAAAAAAAA

SEQ ID NO: 2580 - protein, 153 aa, Antheraea yamamai
GSGAGGAGGDYGWGDGGYGSDSAAAAAAAAAAASGAGGAGGGYGWGDGGYGSDSAAAAAAAAAAAAGSGAGGRGDGGYGSGSSAAAAAAAAAAAARRAGHDRAAGSAAAAAAAAAAAAASGAGGSGGGYGWGDGGYGSDSAAAAAAAAAAAAA

SEQ ID NO: 2581 - protein, 347 aa, Antheraea yamamai
GSGAGGVGGGYGWGDGGYGSDSAAAAAAAAAAAAASGAGGAGGYGGYGSDSAAAAAAAAAAAAASSGAGGAGGGYGWGDGGYGSDSAAAAAAAAAAAAGSGAGGRGDGGYGSGSSAAAAAAAAAAAAASGAGGSGGGYGWGDGGYGSGSAAAAAAAAAAAAAGSGAGGVGGGYGWGDGGYGSDSAAAAAAAAAAAAASGAGGAGGYGGYGSDSAAAAAAAAAAAAAGSGAGGAGGGYGWGDGGYGSDSAAAAAAAAAAAAASGAGGRGDGGYGSGSSAAAAAAAAAAAARRAGYDRAAGSAAAAAAAAAAAAASGAGGSGGGYGWGDGGYGSDSAAAAAAAAAAAAA

SEQ ID NO: 2582 - protein, 251 aa, Antheraea yamamai
GSGAGGVGGGYGWGDGGYGSDSAAAAAAAAAAASGAGGSGGYGGYGSDSAAAAAAAAAAAAAGSGAGGVGGGYGWGDGGYGSDSAAAAAAAAAAASGAGGSGGYGGYGSDSAAAAAAAAAAAAAGSGAGGVGGGYGWGDGGYGGYGSDSAAAAAAAAAAAGSGAGGVGGGYGRGDSGYGSGSSAAAAAAAAAAARRAGHGRSSGSAAAAAAAAAAAAASGAGGSGGGYGWDYGSYGSDSAAAAAAAAAAAA

SEQ ID NO: 2583 - protein, 167 aa, Antheraea pernyi
GKNLRHHDEYVDNHGQLVERFTTRKHFERNAATRPHLSGNERLVETIVLEEDPYGHEDIYEEDVVIKRVPGASSSAAAASSASAGSGQTIIVERQASHGAGGAAGAAAGAAAGSSARRGGGFYETHNSYSSYGSGSSSAAAGSGAGGVGGGYGSDSAAAAAAAAAAA

SEQ ID NO: 2584 - protein, 134 aa, Antheraea pernyi
GSGAGGSGGGYGWGDGGYGSGSSAAAAAAAAAAAGSRRSGHDRAYGAGSAAAAAAAAAAGAGASRQVGIYGTDDGFVLDGGYDSEGSAAAAAAAAAAAASSSGRSTEGHPLLSICCRPCSHSHSYEASRISVHG

SEQ ID NO: 2585 - protein, 186 aa, Antheraea pernyi
GSGAGGAGGGYGWGDSGYGSDSAAAAAAAAAAAAASGAGGSGGYGGYGSDSAAAAAAAAAAAAAGAGAGGAGGSYGWGDGGYGSDSAAAAAAAAAAAAGSGAGGRGDGGYGSGSSAAAAAAAAAASAARRAGHDSAAGSAAAAAAAAAAAAASGAGGSGGGYGWGDGGYGSDSAAAAAAAAAAAAA

SEQ ID NO: 2586 - protein, 186 aa, Antheraea pernyi
GSGAGGAGGGYGWGDGGYGSDSAAAAAAAAAAAAASGARGSGGYGGYGSDSAAAAAAAAAAAAAGSGAGGVGGGYGWGDGGYGSDSAAAAAAAAAAAAGSGAGGRGDGGYGSGSSAAAAAAAAAAAARRAGHDRAAGSAAAAAAAAAAAAASGAGGSGGGYGWGDGGYGSDSAAAAAAAAAAAAAA

SEQ ID NO: 2587 - protein, 249 aa, Antheraea mylitta
GSGAGGRGDGGYGWGDGGYGSDSGAAAAAAAAAAAAASGAGGRGDGGYGRGDGGYGSDSAAAAAAAAAAAAGSGAGGQATVVMDGAMAAMVLTRAQQQLAAAAAAASASGAGGSGGSYEWDYGSYGSDSAAAAAAAAAAAAAGSGAGGVGGGYGRGDGGYGSDSAAAAAAAAAAAAGSGAGGRGDGGYGWGDGGYGSDSGAAAAAAAAAAAAASGAGGRGDGGYGWGDGGYGSDPGAAAAAAAAAAAAA

SEQ ID NO: 2588 - protein, 126 aa, Saturnia japonica
GKTLNHIGLHPKGNTRIDEYVDKTGQLYERYTTREEFERNAATLPHLSRNERLLETIIIEEDPSGHEKIYKEDVVLKRVPGASSAASASSAAAAGSGSRRLGRLHGWDGGAYGSDSAAAAAAAAAA

SEQ ID NO: 2589 - protein, 204 aa, Saturnia japonica
GSGAGGLGGLYGLHGGYYGSDSAAAAAAAAAAAAGSGAGGLGGLYGLHGGVYGSDSAAAAAAAAAATAGSGAEGLGGLYGLHGGYYGSDSGAAAAAAAAAAAGSGAGGLGGHYGLHGGVYGSDSAAAAAAAAAAAAGSGAGGLGGLYGLHGGVYGSSSSRRDSSSASSAAAAAAAAAGSSAASSERVYESESAAAAAAAAAAAA

SEQ ID NO: 2590 - protein, 238 aa, Saturnia japonica
GSGSRGLGGLYGWDGGVYGSDSAAAAAAAAAAAAGSGVSGLGGLYGWDGGVYGSDSAAAAAAAAAAAAGSGSRGLGGLYGWNGGVYGSDSAAAAAAAAAAAAGSGVSGLGGLYGWDRGVYGSDSAAAAAAAAAAAAGSGSRGLGGLYGWNGGVYGSDSAAAAAAAAAAAAGSGVSGLGGLYGWDGGLYGSDSAAAAAAAAAAAAGSGVSGLGGLYGWDGGLYGSDSAAAAAAAAAAAA

SEQ ID NO: 2591 - protein, 238 aa, Saturnia japonica
GSGAGGLGGLYGYHGGVYGSDSAAAAAAAAAAAAGSGISGLGGLYGWDGGLYGSDSAAAAAAAAAAAAGSGSRGLGGLYGWDGGVYGSDSAAAAAAAAAAAAGSGSRGLGGLYGWDGGVYGSDSAAAAAAAAAAAAGSGVSGLGGLYGWDGGLYGSDSSAAAAAAAAAAAGSGSRRLGGLYGWDGGVYGSDSAAAAAAAAAAAAGSGVGGLGGLYGWDGGVYGSDSAAAAAAAAAAAA

SEQ ID NO: 2592 - protein, 136 aa, Rhodinia fugax
GQYIDDDIYRLKRTYGETSNTRSDEYDVDKFGRLYERTTTRKKFEGNSKVSPYISGDEKVVETIVYENNPVGRGTIYEEDVVIKKVPDETSIGTAASSASAGAGLGIAPTIIVERPFENYGGGAAAGAAAAAAAAA

SEQ ID NO: 2593 - protein, 184 aa, Rhodinia fugax
GSSGVGYERGYGSDSAAAAAAAAAAAAAGSGSRGLGGYYGDGLLDGGYGSGSAAAAAAAAAAAADSGSRGLGGYYGDGLLDGEYGSGSAAAAAAAAAAAAGSSGVGYGRRYGSDSAAAAAAAAAAAAGSSSDYTVYESSRRGSSSSAAAAAAAAAAAGSSEAGYERGYESDSAAAAAAAAAAAA

SEQ ID NO: 2594 - protein, 262 aa, Rhodinia fugax
GSGTRGLGGYYGKDGGLLLDGEYGSGSAAAAAAAAAAASGSRGLGGFYGDGLLDGGYGSGSAAAAAAAAAAAGSGSRGLGGFYGDGLLDGGYGSGSAAAAAAAAAAAGSGSRGLGGYYGDGILDDGYGSGSAAAAAAAAAAAAGSGSRGLGGYYGDGLLDGEYGSGSAAAAAAAAAAAAGSSGVGYGRRYGSDSAAAAAAAAAAAAGSSSDYTVYESSRRGSSSSAAAAAAAAAAAGSSEAGYERGYESDSAAAAAAAAAAA

SEQ ID NO: 2595 - protein, 189 aa, Rhodinia fugax
GSGSRGLGGFYGDGLLDGGYGSGSAAAAAAAAAAAGSGSRGLGGYYGDGLLDGGYGSGSAAAAAAAAAAAGSGSRGLGGYYGDGLLDGEYGSGSAAAAAAAAAAAEGSSGVGYGRRYGSDSAAAAAAAAAAAAGSSSDYTVYESSRRRSSSSAAAAAAAAAAAGSSEAGYERGYESDSAAAAAAAAAAA

SEQ ID NO: 2596 - protein, 221 aa, Rhodinia fugax
GSGSRGLGGFYGDGLLDGGYGSGSAAAAAAAAAAAGSGSRGLGGYYGDGLLDGGYGSGSAAAAAAAAAAAGSGSRGLGGYYGDGLLDGGYGSGSAAAAAAAAAAAGSGSGGLGGYYGDGLLDGEYGSGSAAAAAAAAAAAEGSSGVGYGRRYGSDSAAAAAAAAAAAGSSSDYSVYKSSRRESSSSAAAAAAAAAAAGSSEAGYERGYESDSAAAAAAAAA

SEQ ID NO: 2597 - protein, 206 aa, Galleria mellonella
GDAIDDSLLNFNNENFIEIGESTTAEVDVENGTLVERETTRKKYERDGDITPNISGEDKIVRTFVIETDASGHETVYEEDVVIKRKPGQQGVTERTTIGRRQTGISAAPVPAPSSQAPTVVVESNSPIAPAPVSGPVSIGPQLGAVGPYGPSRSSTATTTSGTGVVQQIRTDSTGSSAASAATGASSVAPVIVIEDGSSAASAAAA

SEQ ID NO: 2598 - protein, 102 aa, Galleria mellonella
GSGASGPGGLGLGGLGPYGGIGPNVVSAASAPVVGPSVSSVGPVGAQVIEIGSPVVPSVSRTGSVSRVSVSGRPGVRVPCSLTRRQFVVKIGTRRQPCGYCS

SEQ ID NO: 2599 - protein, 480 aa, Galleria mellonella
GSGASGVGGLGLGALGPLGGIGQSGVSSATTSGAGLGGVGAVGASGLGGLGGAGASAAGSAGAGLGGVGVGGSSGSSAASAASGASGAGEVILIDDRSSAASRAAAGSGASGVGGLGLSGLGPIGGIGPIGATSASTSGAGLGGVGAAGASGLGGLGGAGASAAGSAGAGLGGIGAGGSSGSSAASAASGASGAGEVIVIDDRSSAASAAAASSGASGLGGLGLGGLGPYGGIGLNGVSSASALGAGLGGVGTAGASGLGGLGGAGVSAVGPAGAGLGGVGAGGSSGSSAASAASARSGPAPVIVIEDGSSAASAAAAGSGASGLGGLGLGAWGPLGGIGPNEVSSASATGSAAGSTGAGLGGSGAAGSSAASAASGAAGPAPVIVIEDGSSAASAAAAGSGASGLGGLGLGAMGTLGGIGPNGVSSASATGSAAGSIGSGLCGSGAAGSSLASAASGAAGAAPVIVIEDGSSAASAAAA

SEQ ID NO: 2600 - protein, 561 aa, Galleria mellonella
GSGASGVGGLGLGALGPLGGIGPIGASSAGASGAGLGGVGAAGTSGLGGIGGVGASTAGSAGAGLGGIGAGGSSGSSAASAASGASGAGEVIVIDDRSSAASAAAAGSGASGPGGLGLGVWGPLGGIGPIGASSASASGAGLGGVGAAGTSGLGGLGGAGASAAGSAGAGLGGIGASGSSGSSVASAASGTSGAGEVIVIDDRSSAASAAAAGSGASGLGGLGLGGLGPYGGIGLNGVSSASALGAGLGGVGTAGASGLGGLGGTGASAAGSAGAGLGGVGAGGSFGSSAASAASGASGAGEVIVIDDRSSAASAAAAGSGASGPGGLGLGVWGPLGGIGPNGVSSASATGSAAGSTGAGLGGSGAAGSSAASAASGAAGPAPVIVIEDGSSAASAAAAGSGASGLGGLGLGAWGPLGGIGPNGVSSASATGSAAGSTGAGLGGSGAAGSSAASAASGAAGPAPVIVIEDGSSAASAAAAGSGASGLGGLGLGAWGPLGGIGPNGVSSASATGSAAGSTGAGLGGSGAAGSSAASAASGAAGPAPVIVIEDGSSAASAAAA

SEQ ID NO: 2601 - protein, 131 aa, Bombyx mori
GNINDFDEDYFGSDVTVQSSNTTDEIIRDASGAVIEEQITTKKMQRKNKNHGILGKNEKMIKTFVITTDSDGNESIVEEDVLMKTLSDGTVAQSYVAADAGAYSQSGPYVSNSGYSTHQGYTSDFSTSAAV

SEQ ID NO: 2602 - protein, 150 aa, Bombyx mori
GAGAGSGAASGAGAGAGAGTGSSGFGPYVANGGYSRREGYEYAWSSKSDFETGSGAASGAGAGAGSGAGAGSGAGAGSGAGAGSGAGAGGSVSYGAGRGYGQGAGSAASSVSSASSRSYDYSRRNVRKNCGIPRRQLVVKFRALPCVNCG

SEQ ID NO: 2603 - protein, 403 aa, Bombyx mori
GAGAGSGAGAGSGAGAGSGAGAGSGAGYGAGVGAGYGAGYGAGAGAGYGAGAGSGAGSGAGAGSGAGAGSGAGAGSGAGAGSGAGAGSGAGAGSGAGAGSGAGAGSGAGAGYGAGYGAGAGAGYGAGAGSGAGSGAGAGSGAGAGSGAGAGSGAGAGSGAGAGSGAGAGSGAGAGSGAGAGYGAGVGAGYGAGYGAGAGAGYGAGAGSGAGSGAGAGSGAGAGSGAGAGSGAGVGSGAGAGSGAGAGSGAGAGSGAGAGYGAGYGAGAGAGYGAGAGSGAGSGAGAGSGAGAGSGAGAGSGAGAGSGAGAGSGAGAGSGAGAGSGAGVGYGAGVGAGYGAGYGAGAGAGYGAGAGSGAASGAGAGAGAGAGTGSSGFGPYVANGGYSGYEYAWSSESDFGTGS

SEQ ID NO: 2604 - protein, 319 aa, Bombyx mori
GAGAGSGAGAGAGAGAGSGAGAGYGAGVGAGYGAGYGAGAGAGYGAGAGSGTGSGAGAGSGAGAGYGAGVGAGYGAGAGSGAAFGAGAGAGAGSGAGAGSGAGAGSGAGAGSGAGAGSGAGAGYGAGYGAGVGAGYGAGAGSGAASGAGAGSGAGAGSGAGAGSGAGAGSGAGAGSGAGAGYGAGVGAGYGAGYGAGAGAGYGAGAGSGAASGAGAGSGAGAGAGSGAGAGSGAGAGSGAGAGSGAGSGAGAGSGAGAGSGAGAGYGAGAGSGAASGAGAGAGAGAGTGSSGFGPYVANGGYSGYEYAWSSESDFGTGS

SEQ ID NO: 2605 - protein, 391 aa, Bombyx mori
GAGAGSGAGAGSGAGAGYGAGYGAGVGAGYGAGAGVGYGAGAGAGYGAGAGSGAASGAGAGAGAGAGSGAGAGSGAGAGAGSGAGAGYGAGYGIGVGAGYGAGAGVGYGAGAGAGYGAGAGSGAASGAGAGSGAGAGSGAGAGSGAGAGSGAGAGSGAGAGSGAGAGYGAGYGAGVGAGYGAGAGVGYGAGAGAGYGAGAGSGAASGAGAGAGAGAGAGSGAGAGSGAGAGSGAGAGSGAGAGSGAGAGSGAGAGSGAGAGSGAGAGSGAGAGYGAGVGAGYGAGYGGAGAGYGAGAGSGAASGAGAGSGAGAGSGAGAGSGAGAGSGAGAGSGAGAGYGAGAGSGAASGAGAGAGAGAGTGSSGFGPYVNGGYSGYEYAWSSESDFGTGS

SEQ ID NO: 2606 - protein, 169 aa, Anagasta kuehniella
GADILETGILGGNVREVSESTTDNFTTDGNGNVTEVKTTHKEFRRQGEVPNNISGEDKLVRTFVIETDASGNEVIYEEDVVIHKVPGTSATTKTTTARRQLGGIGGTGAASSSAATSPPRPTSPYGPNGSSSAATSSASGSAPVIVIEENQSSAAAAASSSSSGPNGLL

SEQ ID NO: 2607 - protein, 190 aa, Anagasta kuehniella
GPYGPNGSSASSAASSGAAGAGGLNGIYGSNGALLSGAAGVNGLNGLYGPNGSSASSAGAAGIGGLNGLNGSNGSSSAASSSASGSGPVIVIEENQSSAAAAASSSSSGPNGLLGPYGPNGSAASSAAASNAGNNGPVVIIERGSSSSAAAGSSSSAPYVLPGVRGPCRLTRRQFVVKIGSRRQPCLTCS

SEQ ID NO: 2608 - protein, 228 aa, Anagasta kuehniella
GPYGPNGSAASSAAASGAAGAGGLNGLYGSNGALLSGAAGVNGLNGLYGPNGSSASSAGAAGIGGLNGLNGSNGSASAASSSASGSGPVIVIEENQSSAAAAASSSSSGQNGLLGPYGPNGSSASSAASSGAAGAGGLNGIYGSNGALLSGAAGANGVNGLYGPNGSSASSAGAAGIGGLNGLNGSNGSASAASSSASGSGPVIVIEENQSSAAAAASSSSSGPNGLL

SEQ ID NO: 2609 - protein, 228 aa, Anagasta kuehniella; identical to SEQ ID NO: 2608

SEQ ID NO: 2610 - protein, 308 aa, Artificial Sequence
  Description of Artificial Sequence: Synthetic polypeptide
GYGSGSSAAAAAAAAAAASRRAGHERAAGSAAAAAAAAAAAASGVGRSGGSYGWGDGGYGSDSAAAAAAAAAAAAAASGAGGAGVCRGYGGYGSDGSGSAAAAAAAAAAAGSGAGGVGGGYGWGDGAYGSDSAAAAAAAAAAAAGSGAGGRRGYGAYGSDSSAAAAAAAAAASGAGGSGGGYGWGDGGYGSDSAAAAAAAAAAAAAAGSGAGGIGGGFGRGDGGYGSGSSAAAAAAAAAAAARRAGHGRSAGSAAAAAAAAAAAAASGAGGSGGSYGWDYESYGSGSAAAAAGSGAGGSGGGYGWGDG

SEQ ID NO: 2611 - protein, 91 aa, Antheraea pernyi
GYGAGSAAAAAAAAAAGAGASRQVGIYGTDDGFILDGGYDSEGSAAAAAAAAAAAASSSGRSTEGHPLLSICCRPCSHSHSYEASRMPVHS

SEQ ID NO: 2612 - protein, 156 aa, Bacillus cereus
GATGATGPQGIQGPAGATGATGATGPQGPQGIQGPAGATGATGAQGAQGPAGATGPQGPQGIQGPAGATGATGAQGAQGPAGATGATGATGAQGPQGVQGPAGATGATGAQGPAGATGATGATGAQGPQGVQGPAGATGATGAQGPQGVQGPAGAT

SEQ ID NO: 2613 - protein, 171 aa, Bacillus cereus
GATGAQGPQGIQGPAGATGATGPQGPQGIQGPAGATGATGAQGAQGPAGATGATGAQGAQGPAGATGATGATGAQGPQGVQGPAGATGAQGAQGVQGPAGATGATGAQGPQGVQGPAGATGATGAQGPQGVQGPAGATGATGAQGPQGVQGPAGATGATGAQGPQGVQGPA

SEQ ID NO: 2614 - protein, 340 aa, Bacillus cereus
GLQGPQGIQGVPGPVGATGPEGPQGIQGIQGVQGATGPQGPQGIQGIQGVQGITGATGVQGATGIQGIQGEIGATGPEGPQGVQGAQGAIGPTGPMGPQGVQGVQGIQGATGAQGVQGPQGIQGIQGPTGATGDMGATGATGEGATGPTGVTGPTGVTGPSGGPAGPTGPTGPSGPAGVTGPSGGPPGPTGATGATGITGDTGATGSTGVTGATGETGATGVTGLQGPQGIQGVQGEIGPTGPQGVQGPQGIQGVTGATGDQGPQGIQGPQGDIGPTGPQGIQGPQGSQGIQGATGGTGAQGPQGIQGPQGDIGPTGPQGPTGIQGIQGEIGPTGPEGPE

SEQ ID NO: 2615 - protein, 282 aa, Bacillus thuringiensis
GATGATGPQGAQGPAGATGATGPQGVQGNTGATGATGPQGAQGPAGATGATGPQGVQGNTGATGATGPQGAQGPAGATGATGPQGVQGNTGATGATGPQGVQGNTGATGATGPQGVQGNTGATGATGPQGVQGNTGATGATGPQGVQGPAGATGATGPQGVQGPAGATGATGPQGNTGATGATGPQGAQGPAGATGATGPQGVQGNTGATGATGPQGAQGPAGATGATGPQGVQGNTGATGATGPQGVQGNTGATGATGPQGVQGPAGATGATGPQGVQGNT

SEQ ID NO: 2616 - protein, 384 aa, Bacillus licheniformis
GATGPTGATGPTGATGPTGVTGPTGVTGATGPTGVTGPTGAMGPTGATGATGPTGVTGSTGVTGATGATGPTGVTGPTGAMGPTGATGATGATGATGATGATGPTGVTGATGATGPTGVTGATGATGPTGATGATGPTGATGPTGATGATGPTGATGAMGPTGATGPTGATGPTGVTGSTGATGATGPTGATGAMGPTGATGPTGATGPTGVTGSTGATGATGPTGATGAMGPTGATGPTGATGPTGVTGPTGETGATGPTGATGPTGVTGATGPTGVTGPTGATGATGPTGATGATGATGPTGVTGATGVTGSTGATGPTGATGPTGATGATGATGPTGVTGATGATGPTGVTGPTGATGATGATGATGATGATGPTGVTGAA

SEQ ID NO: 2617 - protein, 243 aa, Bacillus licheniformis
GPTGATGPTGTTGAMGPTGATGPTGTTGAMGPTGATGPTGTTGAMGPTGATGPTGTTGAMGPTGATGPTGTTGAMGPTGATGPTGTTGAMGPTGATGPTGATGPTGVTGSTGATGATGATGPTGATGAMGPTGATGPTGATGPTGVTGATGPTGVTGPTGATGATGPTGATGATGATGPTGPTGVTGAAGATGPTGVTGATGVTGSTGATGATGATGATGPTGVTGAAGATGPTGAAGATGPA

SEQ ID NO: 2618 - protein, 210 aa, Neospora caninum
GGAEEKAMKPSESPESAKNEAGGAEEKAMKPSGSAESAKNEAGGAEEKETKPSESPESAKNEARGAEGKETKPSESPESAKNEAGGAEEKETKPSESPESAKNEAGGAEDKAMKPSESAESAKTEAGGAEEKAMKPSESPESAKNEAGGAEETSMKPSGSAESAKNEAGGAEEKETKPSESPESAKNEARGAEGKETKPSESPESAKNEA

SEQ ID NO: 2619 - protein, 301 aa, Danio rerio
GDSNTDTNTDTNTDKNFDANTDSNTDSNTETNTDSNTETNTDSNTDTNTDSNTDTNTDKNTDTNTDSNTDTNTDTNTNTDTNTDTNTNTDTFTDKNTDSNTDTNTDTHTDTNSDSNTDTNKDTNTDKNTDTNTDSNTDSNTDTNTDTNTDTNTDKNFDANTDSNTDSNTDTNTDSNTETNTDSNTDTNTDSNTDTNTDKNTDTNTDSNTDTNTDKNTDTNTDSNTDTNTDSNTDTNTDKNTDTNTDSNTDTNTDSNTDTNMDTNTDKNTDTKTDSNTDSNTDTNTDSNTDKNTDTKTDSNT

SEQ ID NO: 2620 - protein, 193 aa, Danio rerio
GDIRDARDVRDARDIRDIRDARDIRDPRDIRDIRDSRDIRDIRDARDIRDMRDPRDVRDVRDPRDVRDVRDIRDVRDVRDIRDSREVRDGRDAREVRDIRDAREVRDIRDAREVRDIRDAREVRDIRDPREVRDTREVRDAREVRDARDAREVREAREARDVRDARDVRDIREAREVRDVRDAREVRDIRDVR

SEQ ID NO: 2621 - protein, 174 aa, Artificial Sequence
  Description of Artificial Sequence: Synthetic polypeptide
GKESDRSKERDRERDRSRERDREQGHSREKEREHSKERDRSRGRESDRGKESDRGKESERGKESERGKESERGKESERGKEFDRGKESDRGKESDRGKESDRGKESERGKESERGKESDRGKESDRGKESDRGKESDRGKESDRGKESDRGKESDRGKESDRGKESDRGKESDR

SEQ ID NO: 2622 - protein, 119 aa, Atta cephalotes
GRPEMYPEGVRPGTVISGAERTYPGGVRPGTVTPGTEEIYPGGARPGTVTPGIEEIYPGGVRPGTVIPGAERTYPGGVHPDIVLPGVEKSYPIDIRPGTVTPGADGMYPESVRPGSVTP

SEQ ID NO: 2623 - protein, 224 aa, Ureaplasma urealyticum
GSTTQPGSGSTTQPGSGSTTQPGSGSTTQPGSGSTTQPGSGSTTQPGSGSTTQPGSGSTTQPGSGSTTQPGSGSTTQPGSGSTTQPGSGSTTQPGSGSTTQPGSGSTTQPGSGSTTQPGSGSTTQPGSGSTTQPGSGSTTQPGSGSTTQPGSGSTTQPGSGSTTQPGSGSTTQPGSGSTTQPGSGSTTQPGSGSTTQPGSGSTTQPGSGSTTQPGSGSTTQPGS

SEQ ID NO: 2624 - protein, 160 aa, Bombus terrestris
GSPRTTTGGGIAYPGGIPTTTTGGGIAYPGNIPTTTTGGGVAYPGNIPTTTTGGGTVYPGGVPSTTITGSTVYPGGVPSTITGGDVAYPGDVPSTTITGTVYPGGVSSDGAAYPGSMPGTTIGGGVTYPGSIPSTTTGGGIAYSGSIPGITTGGGVTYPR

SEQ ID NO: 2625 - protein, 210 aa, Bombus terrestris
GVPGTITGADAVHPEGVPGATTGLSITYPGGVPGTVTGGDVVHPKSAPGTTTGRGVTYPGGVPGTVTGGGVVNPKSAPGTTTGHGVAYPGGVPRTLTGGSTVYPGGVSGITTGGHVAYPGGVAATTIGGNVAYPGGVPSTTTGGGVTYPGGVLGTTTGDGAVYPGGLPGTATVGGITYPGIISGTTTGSGIAYPGGVPGTTTSDDVTYPG

SEQ ID NO: 2626 - protein, 160 aa, Bombus impatiens
GHHGIPWDTMEYPGTPWNTLGHHGIPWDTMEYPGTPWNTLGHHGIPWDTMEYPGTPWNTLGHHGIPWDTMEYPGTPWNTLGHHGIPWDTMEYPGTPWNTLGHHGIPWDTMEYPGTPWNTLGHHGIPWDTMEYPGTPWNTLGHHGIPWDTMEYPGTPWNTL

SEQ ID NO: 2627 - protein, 160 aa, Artificial Sequence
  Description of Artificial Sequence: Synthetic polypeptide
GIHQEATSEIHPEATSEIPPEITSEIHPEATGEIHPETISGIHQEATSEIHPEATSEIPPEITREIHPEATGEIHPETISGIHQEATSEIHPEATSEIPPEITSEIHPEATGEIHPETISGIHQEATSEIHPEATSEIPPEITREIHPEATGEIHPETIS

SEQ ID NO: 2628 - protein, 138 aa, Bombus impatiens
GLPPQTTRELHSQSASDLHRPSTSQIHRRPTSKIHPDPTCEIHQASTSEKHPEATCEIHPESTSEILPETTNDIHRPSARQINRPSTSEIPREITREIHPEATSETHPETTNEIHRPSTSQIHRPSTSQILPETRSEL

SEQ ID NO: 2629 - protein, 243 aa, Artificial Sequence
  Description of Artificial Sequence: Synthetic polypeptide
GPWSKCSKHCGEGGEQSRGIKCEQVISGGIPTVVDDSQCLEKVGPKGPTKQECNKNVTCPQFHVGPWKPCDHLCGPGKQTRKVTCYMKVNGKIQLLKDQACEGEVPKSEKPCELRPCAGLDWVTSDWSGCDDKCGLTEETRTTYCATQDGTVYPDEKCDAEKKPELTRDCEAEKDCEFLWFASQWSDCSAKCGSGVQTRKVFCGTFDDETVKKVPDEKCDADKKFNETKSCIAKEECKGEWFA

SEQ ID NO: 2630 - protein, 130 aa, Bombus impatiens
GATAESAATTEPGATTESAATEITESTESGATEVTESTESGATTESGATTESGATTESGATTESGATTESGATIESGATTESGATTESGATTESGATTESAATTEPGTTIESGATTESGATTESGATTES

SEQ ID NO: 2631 - protein, 255 aa, Drosophila yakuba
GIGGQTGAGQPGYGSQPGVAGQTGAGQPGYGSQPGVAGQNGAGQPGYGSQPGVAGQNVAGQPGYGTQPGIGGQTGAGQPGYGSQPGIGGQTGGGQPGYGSQPGIGGQTGAGQPGYGSQPGVGGQTGAGQPEVGGQTGAGQPGFGAQPGIGGQTGAGQPGYGTQPGIGGQTGAGQPGYGSQPGIGGQTGGGQPGYGSQPGIGGQTGAGQPGYGSQPGVGGQTGAGQPGYGSQPGVGGQTGAGQPGYGSQPGVGGQT

SEQ ID NO: 2632 - protein, 181 aa, Drosophila yakuba
GVGGQTGAGQPGFGAQPGIGGQTGAGQPGYGTQPGIGGQTGAGQPGYGSQPGVGGQTGAGQPGVGGQTGAGQPGFGAQPGIGGQTGAGQPGYGTQPGIGGQTGAGQPGYGTQPGIGGQTGSGQPGYGSQPGIGGQTGAGLPGYGTQPGIGGQTGAGQPGYGSQPGVAGQTGAGQPGYGTQP

SEQ ID NO: 2633 - protein, 272 aa, Pseudomonas syringae
GYGSTQTAGGDSALTAGYGSTQTAREGSNLTAGYGSTGTAGSDSSLIAGYGSTQTSGEDSSLTAGYGSTQTAQEGSNLTAGYGSTGTAGSDSSLIAGYGSTQTSGGDSSLTAGYGSTQTAQEGSNLTSGYGSTGTAGADSSLIAGYGSTQTSGSDSALTAGYGSTQTAQEGSNLTAGYGSTGTAGSDSSLIAGYGSTQTSGSDSSLTAGYGSTQTAQEGSNLTAGYGSTGTAGVDSSLIAGYGSTQTSGSDSALTAGYGSTQTAQEGSNLTA

SEQ ID NO: 2634 - protein, 150 aa, Phytophthora infestans
GAGLNAGAGLNAGAGLNAGAGLNAGAGLKVGAGLNAGAGLNVGAGLNTGARFSANAGLKASAGLNAGAGLNAGAGLKVGAGLNAGAGLNVGAGLNTGAGLNANAGLKANAGLNAGAGLKVGAGLNVGAGLTAGTGLNANAGLKANAGLNA

SEQ ID NO: 2635 - protein, 197 aa, Phytophthora sojae
GVCGCSGGRQLVNGVCKCTGGQELVGGSCACTCGQELVNGVCTCPGGQKLVGDKCMCTGGQTMVNDVCACTGGQTLVDGVCACTGGQKLVDGVCTCTGGRSLVDGVCACTGGQLFANDVCACPALMSLKNGECSCDGGRAEVRPDVCECTGGQEIANGECACTGGQTLVDGVCRCPSLMSLEHGVCTCDGGRTEVST

SEQ ID NO: 2636 - protein, 172 aa, Polysphondylium pallidum
GSTTTSGNGSGTSSTTTNNGSGAGSTTTSGNDSGVGSTTTSGNGSGAESTTNGNDSGVGSTTTSGAASTATSANGSGAESTTTSGNGSSSGSTTTSGNGSGAASTTNGNDSGVGSTTTSGAASTTTSGNGSGVGSTTSSGNGSGTGSTSSGIGSTTTSVNGSGTGTTTSSGI

SEQ ID NO: 2637 - protein, 156 aa, Rhipicephalus pulchellus
GGLGVGGLGVGGGLGGGSHYSSSSYSSGHGSGVGVGAGLASGAALGSGAGLATGAALGSGAGLASGAGLGYGAGLASGAALGSGAGLATGAALGTGAGLASGAALGSGAGLATGAALGSGAGLAAGAGLGYGAGHASGAALGSGAGLASGAALGSG

SEQ ID NO: 2638 - protein, 215 aa, Culex quinquefasciatus
GTGVSGGPGYPGTVGAGQYPGVGGLPGTSGQYPGGQYPGTGAGGVPGYSGYPGTSGAGHYPGTSGTPGAGTGPGTGGIGQHGGQLSTGTGAGVGHQGSGVGQYPGTGATGGYPYPGTTGQYPGTSGIPGAGTGQYYPGGTGVGGLPGGVGQHGGQLSTGAGTGLGQQGGGVGQYPGTGVGGGPGYPYHHGTSGQYPGGQYPGTGAAGGPGYTGYP

SEQ ID NO: 2639 - protein, 140 aa, Tribolium castaneum
GPAPYPTAPGGVGKITYPVGPGGVPGYPGTPTYPSIPGYPTPGHPVTEPGYPGVPSYPGAPRPGVPSGPSGPSYPGGQIPGYPGVPSPGFPGGPPPGYPGVPTAGYPGIPTGPGVPSYPGGPSVSFPGVPSVPPGVPSYP

SEQ ID NO: 2640 - protein, 208 aa, Tribolium castaneum
GAPSPGYPGAPSSGYPGAPSPGYPGAPSPGYPGAPSPGYPGAPYPGYPEAPTPSYPGAPTPGYPGAPSPGYPGAPAPGYPEAPYPGYPGVPSPGYPGAPSPGYPGAPSPGYPGAPSSGYPGAPSPGYPGAPSPGYPGAPSPGYPGAPYPGYPEAPTPSYPGAPTPGYPGAPSPGYPGAPAPGYPEAPYPGYPGVPSPGYPGAPSPGYP

SEQ ID NO: 2641 - protein, 265 aa, Streptococcus pyogenes
GLTGPAGQDGKQGPQGPRGLTGPAGQDGKQGPQGPRGLTGPAGQDGKQGPQGPRGLTGPAGQDGKQGPQGPRGLTGPAGQDGKQGPRGLTGPAGQDGKQGPRGLTGPAGQDGKQGPQGPRGLTGPAGQDGKQGPQGQPGQVGPRGLQGPQGPRGDKGETGPQGPAGKDGEAGAQGPVGPAGPQGPRGDKGETGPQGPAGKDGERGPVGPAGKDGQNGKDGLPGKDGKDGQNGKDGLPGKDGKDGQDGKDGLPGKDGKDGQPGKPA

SEQ ID NO: 2642 - protein, 180 aa, Candidatus microthrix
  Candidatus microthrix parvicella
GDTGPTGPTGASGPSGETGPTGPTGVSGPSGETGPTGPTGASGPSGDTGPTGPTGASGPSGDTGPTGPTGASGPSGETGPTGPTGASGPSGETGPTGPTGASGPSGETGPTGPTGASGPSGETGPTGPTGVSGPSGDTGPTGPTGATGPSGETGPTGPTGATGPSGETGPTGPTGATGPS

SEQ ID NO: 2643 - protein, 274 aa, Artificial Sequence
  Description of Artificial Sequence: Synthetic polypeptide
GNQILDPRTCVCKKCIATACPDNSHYSFSTCRCECPQHQKCPHGQYFNSETCKCGCSPHIKCHSPRVLNKDACKCECPKNVHCLPPLTFDERTCACHCPEHHSHCPTGKIYSYTECGCICSEKAYCHLPRFFNNETCKCECKGERNCVHPKVYSETNCNCQCPEDDYCPRHKTINPETCECSCPAELSCRSPQVLNDKTCKCVCPPHTRRCPPGKELDDFTCECSCPEVFCPLPKLQNPYTCKCACPDTLTCPYGQVVDPENCQCSCPKKLSCS

SEQ ID NO: 2644 - protein, 162 aa, Acyrthosiphon pisum
GNQDHGYGVRPLVDGQYRGSGTNNKLPGNQYQGYGITPSIDGQYTSSGTNNKLPGNQNQGYGINPSIVGQYPGLGTNNNLPGNQDHGYGVRPLVDGQYRGSGTNNKLPGNQYQGYGITPSIDGQYTSSGTNNKLPGNQNQGYGINPSIVGQYPGLGTNNNLP

SEQ ID NO: 2645 - protein, 165 aa, Acyrthosiphon pisum
GSGGSGVQQSGNVPSGVNINQIQPSYGQPHGTLYSGGTGVQQPGYASSGENLNPIQPSYGQPHGTLGSGGSGVQQSGNVPSGVNINQIQPTYGQPQGTLGSGGSGVQQSGNVPSGGNLNPIQPSYSQPHGTLYSGGTGVQQPGYASSGGNLNPIQPSYGQPHGTL

SEQ ID NO: 2646 - protein, 268 aa, Caenorhabditis brenneri
GGDLPDKPIPGGQEEVERPWPETGDLPDKPIETDQFDTTAGPSFWDTTHSDHTESMEIFEVPPNEIDDGGDLPDKPIPGGQVEQPGPGIDGLPDKPIETDPFDTTTDGSFWDTTHSDHTEPMEIFEVPGSEIDDGGDLPDKPIPGGQVEQPWPGPDDLPDKPLNIDPSDTTTDSSFWDTTHSDHTVPMEVFEVPPNEIDEGGGLPDKPIPSDRDHVEQPEPETGDLPDKPIGINPSDTTTDSSFWDTTHFDHTVPMEIFEVPPSEIDE

SEQ ID NO: 2647 - protein, 339 aa, Caenorhabditis brenneri
GGVVPVIPGGPNIPGGPGDPIGPGGPVEPGTPEGPDGPGIPGGPNGPGGPGITEGPNESNHLTTKIPITTTTDRNGGGVVPVLPGGPGGPRKPGGPSGPNGPGNPGGPVNPGGPTGPDGPGNPPGSETPGGSGTPIGPNGPVGPGSPDGPRGPSGPDGPKGGTQNTGSPSGPSGPDNPNGPGGPSNPGGPSGPTGPEGPDESNRLSTKIPITSTTTDRVGGGIPVIPGGPNIPGGPRGPSGPSIPGEPAGPDGSGGPGGPVNPGGPTGPHGPGNPPGPSIPGGPGGPDGPGSPSGPSGPDSPGSPNGPSNTGSPRGPSGPDGPNQQPTSKPEKQNEQSS

SEQ ID NO: 2648 - protein, 280 aa, Burkholderia pseudomallei
GTNSTASGDNSTASGTNASATGENSTASGTNASATGENSTATGTASTASGSNSTANGTNSTASGENSTATGTDSTASGSNSTANGTNSTASGDNSTASGTNASATGENSTATGTDSTASGSNSTANGTNSTASGDNSTASGTNASATGENSTATGTDSTASGSNSTANGANSTASGDNSTASGTNASATGENSTATGTDSTASGSNSTANGTNSTASGNNSTASGTNASATGENSTATGTDSAASGTNSTANGTNSTASGDNSTASGTNASATGENSTAT

SEQ ID NO: 2649 - protein, 250 aa, Mustela putorius furo
GSGLSGVSMAGSECSGASMAGSGHSRVSVAGSEYTGASMAGSGHSRASGAGSEWSRTSMAGSGLSGVSVAGSEYPGASMAGSGHSGAPVSGSGSSGASMAGSGLSRASGAGSECSRTSVAGSGHSRTSVAGSECSRVSRAGSECSRASVADSGYSGASEVGSRSSRASLAGLVHFGASIACSGHSEASMEGLECSGASVPDSRHSVASVTDGGHSVASVADSVHSVVSMTGLGQFVSSVSEPGHSTASVA

SEQ ID NO: 2650 - protein, 152 aa, Candida parapsilosis
GIATPSDTNSYESTTTVTDMTTSTHTTVVTTTWLVTNSDGSVETETGIATPSDTNSYESTTTVTDTTFTTETTVITTTWLVTKSDGSVETETGVITQSGDSSSTITTFETSSDTNSYDSTTTVTDTTTTTETTVFTTTWIVTKSDGSVETET

SEQ ID NO: 2651 - protein, 360 aa, Candida parapsilosis
GEPTGSGSESTGEPTGEPSGSGSESTGEPTGEPTGEPSGSGSESTGEPTGEPSGSGSESAGGSSTPGYSVSTTTDTTTTTETTTTTTTTTWTVTKSDGSVETESGIVSGSDSSLTTITTFEPPSSSSGFGTESGLITDTNNESSAGSTGGASEPTGGASESTGGASEPTGEPTGGASESTGGASEPTGEPSGGASESTGGASEPTGEPTGGASESTGGASEPTGGASESTGGASEPTGNGSESTGEPTGEPTGGASESTGGASEPTGEPTGGASESTGGASEPTGEPTGGASESTGGASEPTGEPTGGASESTDGASEPTGEPTGGASESTGGASEPTGEPTGNGSETTGGSSTPGYSVS

SEQ ID NO: 2652 - protein, 211 aa, Candida parapsilosis
GDNGTGSGNTGDNGTGSGNTGDNGTGSGNTGDNGTGSGNTGDNGTGAGDNGTGAGDNGTGSGNTGDNGTGSGNTGDNGTGSGNTGDNGTGSGNTGDNGTGAGDNGTGAGDNGTGSGNTGDNGTGSGNTGDNGTGSGNTGDNGTGAGDNGTGAGDNGTGSGNTGDNGTGSGNTGDNGTGAGDNGTGSGNTGDNGTGAGDNGTGSGNTGDNGT

SEQ ID NO: 2653 - protein, 231 aa, Paenibacillus sp
GAQGPQGVQGVQGDQGPQGVQGAQGDQGPQGVQGVQGDQGPQGVQGVQGDQGPQGVQGVQGDQGPQGVQGVQGDQGPQGVQGAQGDQGPQGVQGVQGDQGPQGVQGVQGDQGPQGAQGVQGDQGPQGVQGPQGDQGPQGVQGVQGDQGPQGVQGVQGAQGPLGPQGIQGPLGAQGPLGPQGAEGPLGAQGPLGPQGAEGPLGAQGPLGPQGAEGPLGAQGPLGPQGAEGPL

SEQ ID NO: 2654 - protein, 334 aa, Xenopus tropicalis
GIGGIPGAVPGTGLGGVPGLTPGGGAVPGVVPGLVPGAGGVPGAGIPQLGVQPGAKASKYGLPGVGGVPGVGGVPGVGGVPGVGGVPGVGGVPGVGGVPGVGGVPGPTISGLGAKPPKIGGVGAGGFPAGVGVGGVPGAGAYPAGGKPPKPGYGAGAGLIPGGGITPGAGLGAGLVPGAGTGAGLYPGGKPPKPGYGLPGGALTPGAGLQPGAGLQPGAGLQPGAGLQPGAGLQPGAGLQPGAATGAGTYPGGKPPKPGLGIGGLTPGVAGLGPGAGLVPGAGGLAPGAAGGAYPGGKPPKPGAGLVPGAGGLAPGAGGLAPGAGGLVPGAGGL

SEQ ID NO: 2655 - protein, 292 aa, Xenopus tropicalis
GGIATGVAPGGAGGLYPGAGGKPPKPGYGPGAGFVPGAGIGAGAGAGLQPGGIGAGVAPGGVGAGGLYPGAGGKPPKPGYGPGAGWVPGAGVGLGTGVQPGGTGTGVAPGGIGAGGLYPGAGGKPPKPGYGLGAGLVPGAGVGPGAGLQPGGIGAGGVGAGGLYPGGKPPKPGYGPGAGYVPGAGYVPGAGVGPGAGLQPGGIGAGVAPGGVGAGGLYPGGKPPKPGYGPRAGLGTGAGIGAGLQPGGIGAGVAPGGVGAGGLYPGGKPPKPGYGPGAGFVPGVSNGAGQQP

SEQ ID NO: 2656 - protein, 252 aa, Anopheles darlingi
GGPGGAGGPGVDAHGRPTGGSGTGGPLVDAYGRPISGGHGGRPAGGSGTSGGPGVDAHGRPIGGSGTGGIDGQGRPSGGTAVDAYGRPIGGPGTGSPGSGGAGTGVPGVDGRGRPSGGPGVDAHGRPIGGTGAGGPGTTGTGTGGGVDAYGRPIGGQGTNGHDARGPPVDSHGRPIGGPGTGGLGSPIGTGIGGVDAYGRPSGPGGQGSGTPGGAPGHSGLGTGGHGVDAHGRPIGGPGTGVSGVDAHGRPI

SEQ ID NO: 2657 - protein, 243 aa, Anopheles darlingi
GVGQYPSGTGAGQYPSGTGAGQYPSGTGGTSGTGQYPGGTGAGQYPGGIGGTGGVGQYPGSTGTGQYPGGTGGTGGAGQYPSGTGAGQYPSGTGGTGGAGQYPGSTGVGQIPGGTGHYPSGTGAGQYPSGTGGTGGAGQYPGSTGAGQHPGGLGGTGGTGQYPSGTGAGQYPSGTGGTGGAGQYPGSGQYPSGTGGTGSAGQYPSGTGGAGQYPTGTGGAGGVGQYPSGTGAGQYPSGTGGIG

SEQ ID NO: 2658 - protein, 221 aa, Drosophila melanogaster
GIGGQTGAGQPGYGSQPGIGGQTGAGQPGYGSQPVVGAQTGTGQPGYGAQPGVGTQTGAGQPGYGSQPGIGGQTGARQPGYVTQPGVGAQTGIGQPGYGAQPGILGQTGAGQPGYGSQPGIGGQTGAGQPGYGTQPGVGAQTGTGQPGYGAQPGVGTQTGAGQPGYGSQPGIGGQTGAGQPGYGTQPGVGAQTGAGQPGYGAQPGVGAQTGAGQPGYGSQP

SEQ ID NO: 2659 - protein, 256 aa, Drosophila melanogaster
GIGGQTGGGQPGYGSQIGGQTGAGQPSYGSQPGVGAQNGAGQPGYGTQPVIGGQTGAGQPGYGGQTGVGGSPGFLTQPGIGGISGPIGGKLGGGQSEAAKPGYWAQPGIGGPSRYGSQPGIGDQTGTGQSGYGGQPGISGQTGGGQPGYGGQATISGLPGYGTQPGIGALTAVPGGHYGYETQPGIGGQTGTNQPGFGGQPGIGGQTGAGQPGYGFIGQPGIGGQTGTSGRQPGYGTQPGIGGQTAAGQPGYGSQT

SEQ ID NO: 2660 - protein, 252 aa, Synechococcus phage P60
GADGADGVDGVDGLGWTGGSYDPLTGVVTFTSDDGLGFVTGDLRGADGADGVDGVDGAVGPQGPEGPQGLQGDTGPQGPQGLQGEQGLQGPQGLPGADGADGAQGPQGIQGEQGLQGPQGLPGADGADSTVPGPQGPKGDKGDTGDAGPQGPKGDTGDAGPQGLKGDPGNDGADGATGPEGPQGPQGNPGADGADGAQGPKGDKGDTGDPGAQGPQGNPGDQGPQGNPGADGADGAIGPEGPQGPQGPEGPE

SEQ ID NO: 2661 - protein, 311 aa, Amblyomma variegatum
GPYGSSLGYSAFYGSRVGPFGTYGTSGLFGSGYGPFGHLGPYGSALGYSGLYGSRLGPFGTYGTSALYGSGYGPFGHLGPYGSTLGYSGLYGSRLGPFGTYGTSGVFGSGYGPFGHLGPYSSTLGYSGLYGSRLGPFGTYGTSALYGSGYGPFGHLGPYGSTLGYSGLYSSRLGPFGTYGTPGLFGSGYGPFGHLGPYGSTLGYSGLYGSGLGPFGTYGTSLFGSGYGPFGHLGPYGSSLGYSGLYGSSLGPFGPYGTSGLFGSVYGPFGHLGPYGSTLGYSGLYGSRLGPFGTYGTSSLYGSGYGPFGPL

SEQ ID NO: 2662 - protein, 218 aa, Kazachstania naganishii
GPSSGASGHSGPSSGASGHSGPSSGASGHSGPSSGASGHSGPSSGASGHSVTSSHTGPSSGASGHSGPSSGASGHSGPSSGASGHSGPSSGASGHSVTSSHTGPSSGASGHSGPSSGASGHSGPSSGASGHSGPSSGASGHSGPSSGASGHSGPSSGASGHSVTSSHTGPSSGASGHSGPSSGASGHSGPSSGASGHSGPSSGASGHSGPSSGASGHS

SEQ ID NO: 2663 - protein, 275 aa, Drosophila ananassae
GIGGGQPGIGVQPGYGGQTGGQPGYRGQTGTGTGQPGYGGQTGIGGGATQPSYAQTGGQPGYGGGQQVQPGYGGQTGAGQPGYGGQIGTGQPGYGGQTGIGGGQPSTGIQPGYGAQPGYGGQTGTGTGQPGYGGPAGTGPGLPGYGGQTGTGAGQPGFGGQTGAGQPGFGGQTGTGVGQPGYGGQAGTGQPGYGGQTGGQPGYGGQTGTGTGQPGYGGQTGIGGGQPGYGGQTGTGTGKPGYGEQTGTGAAQPSYGQTAGQPGYGGGLPGQLVQP

SEQ ID NO: 2664 - protein, 159 aa, Tetrapisispora blattae
GYTPSGKSSESSMNTASSESSMNTASSESWIKTASSESSMNTASSESSMNTASSESWINTASSESSMNTASSESWINTASSESSMNSASSESWINTASSESWMNTASSESWINTASSESSMNTASSESWINTASSESSMSTASSESWINTASSESSMST

SEQ ID NO: 2665 - protein, 282 aa, Tetrapisispora blattae
GTTTYRVSGSSSASSDVPPVYTTTVTSGSSTETDVVSEYSTTDSNGMPSTGTTTYHVSGSSSASSDVPPVYTTTVTSGSSTETDVVSEYSTTDSNGMPSTGTTTYHVSGSSSASSDVPPVYTTTVTSGSSTETDVVSEYSTTDSNGMPSTGTTTYEVTDSCPDCSTGAPSHRSNEVSSMPSSFATSSMSSISPATSSGMPPVYTTTVTSGSSTETDVVSEYSTTDSNGMPSTGTTTYHVSGSSSASSDVPPVYTTTVTSGSSTETDVVSEYSTTDSNGMPST

SEQ ID NO: 2666 - protein, 220 aa, Monodelphis domestica
GTYPPGQAPPGTYAPGQGPPGTYPPGQGPPGTYAPGQGPPGTYPPGQGPPGTYAPGQGPPGTYPPGQGPPGTYPPGQGPAGTYPPGQGPPGTYPPGQAPPGTYPPGQGPPGTYLPGQGPPGTYPPGQGPPGTYQPGEGAPGTYQPGPGAPGTYAPGQGPPGTYPPEQGPPGTYPPGQGPAGTYPPGQGPPGTYPPGQAPPGTYPPGQGPPGTYLPGQGPP

SEQ ID NO: 2667 - protein, 271 aa, Amblyomma variegatum
GLLGGYPGLGGLSSLYGGYPGLLGGLSGLGGPLGLGRYPGLSGLYGRYGTLGSLSSLYGGYPGYGGLSGLLGSYAGLGGLSTLYGGYPGLLGGLSGVGGPFGLGRYPGLSGLYGRYGTLGSLSTLYGGYPGYGGLSGLLGGYPGLGGLSGLYGGYPGVLGGLSGLGGRLGLLGRYPGLSGLYGGYGTLGSLSTLYGGYPGLTGVSSLYGGYSGALGGLSGLGGPLGVLGHYPGLYSSGLGSLGLLGPYGSSLGYSALYGSRVGPFGPYGTS

SEQ ID NO: 2668 - protein, 273 aa, Amblyomma variegatum
GLFGSVYGPIGHLGPYGSTLGYSGLYGSSLGPFGTYSTSGLFGSGYGPFGHLGPYGSTLGYSGLYGSRLGPFGTYGTSSLYGSGYGPFGHLGPYGSTLGYSGLYGSRLGPFGTYGTSGLFGSGYGPFGHLGPYGSTLGYSGVYGSRLGPFGTYGTSGLFGSSYGPFGHLGPYGSTLGYSGLYGSSLGPFGTYSTSGLFGSGYGPFGHLGPYGSTLGYSGLYGSRLGPFGTYGTSSLYGSGYGPFGPLGPYGSTLGYSGLYGSSVGPFGTYGTS

SEQ ID NO: 2669 - protein, 224 aa, Latrodectus hesperus
GQGSPGSGQPGSGHPGSGQPGSGSPGSGQPGSGSPGSGQPGSGSPGSGQPGSGSPGSGQPGYYQPGSQGQPGNGQPGSGQPGSGQPESGQPGNGQPGSGQPGSGEPGSGQPGYYRPGGKGQPGNGQPGSGQPGSGEPGSGQPGSGQPGYYRPGGKGQPGNGQPGSSQPGSGEPGSGQPGSGQPGYYRPGGKGQPGNGQPGSGQPGSGEPGSSQPGSGQPGYYRP

SEQ ID NO: 2670 - protein, 240 aa, Danaus plexippus
GQGMRPGQGMGPSQGMGPGQGMGPGQGIGPGQGMGPGQGVGPGQGIGPGQSVRPGQGMGPGQGMGPGQGVGPGQEMGPGQGIGPGQGMRPGQGVGPGQGMGHGQGMEPGQGMGPGQGLGPGQGVGPGQGIGSEQGMGPGQSMGPGQGMGPRQGMGPGKGFGSGQGIGPGQSMGPGQGMGPGQDVGPGQGIGSGQGIGPGQGIGRGQVLGPGQVIEPGQGLGPGQGIGPSQGMSPGQLMGP

SEQ ID NO: 2671 - protein, 204 aa, Encephalitozoon intestinalis
GEGEEGEDKDNTGEGEEGEDKDNTGEGEEGEDKDNTGEGEEGEDKDNTGEGEEGEDKDNTGEGEEGEDKDNTGEGEEGEDKDNTGEGEEGEDKDNTGEGEEGEDKDNTGEGEEGEDKDNTGEGEEGEDKDNTGEGEEGEDKDNTGEGEEGEDKDNTGEGEEGEDKDNTGEGEEGEDKDNTGEGEEGEDKDNTGEGEEGEDKDNT

SEQ ID NO: 2672 - protein, 189 aa, Encephalitozoon intestinalis
GEGEEGEEGEDKDNTGEGEEGEEGEDKDNTGEGEEGEEGEDKDNTGEGEEGEDKDNTGEGEEGEDKDNTGEGDEGEDKDNTGEGEEGEEGEDKDNTGEGEEGEDKDNTGEGEEGEEGEDKDNTGEGEEGEEGEDKDNTGEGEEGEEGEDKDNTGEGEEGEDKDNTGEGEEGEDKDNTGEGEEGEDKDNT

SEQ ID NO: 2673 - protein, 121 aa, Psychromonas ingrahamii
GQQKNSEQQKNNEQQKNSEQQKNNEQQKNSEQQKNSEQQKNNEQQKNNEQQKNNEQQKNNEQQKNNEQQKNNEQQKNNEQQKNNEQQKNSEQQKNNEQQKNSEQQKNNEQQKNNEQQKNNE

SEQ ID NO: 2674 - protein, 354 aa, Drosophila melanogaster
GLPPGSIPPLRPPNQGGHPPGSQKPPNVGIYPPSTGWIPPFGPLTQGGHPPGSLLPPNTGLPPGSIPPLGSPNQIGHPPGSQKPPNVGIYPPSTGWTPPSGPLTQGGHPPGSLLPPNTGLPPGSIPPLGSPNQIGHPPGSQKPPNVGIYPPSTGWIPPSGPLTQSGHPPGSLLPPNTGLPPGSIPPLRPPNQGGHPPGSQKPPNVGIYPPSTGWIPPSGPLTQGGHPPGSLLPPNTGLPSGSIPPLGSPNQIGHPPGSQKPPNSGIYPPSTGSIPPSGPLTQGGHPPGSLLPPNTGLPSGSIPPLGSPNQIGHPPGSQKPPNSGIYPPSTGWIPPSGPLTQGGHPPGSLLPPNT

SEQ ID NO: 2675 - protein, 198 aa, Chironomus tentans
GAQKWCDKTCKCKCEKEMPTGGCENNKKWCDETCDCVCPQKNTCIAPKVWDAKTCSCICVNPPKCNSPQVLKDTCCCGCQNVKSCKAPQKFIENICDCACPNKKQCKAPLVWSDEFCDCVCPNSASMKTCLSPKEWNKVTCTCDCNPPKPDCCPGTQKWMDDKCKCGCPNAQTDCAGGKKFNDFTCSCGCPSGKLDCT

SEQ ID NO: 2676 - protein, 275 aa, Acyrthosiphon pisum
GGGMHHQHQQHQQQQQHGKHHLLLHHHHTHDHQNSHNNGNHHDSDHDHVHHMHHHLQQHGGGDDDSSSSMLVGSLLQHHQHQQQQHQQQQHHHQQQHHHQQQHSPVDIYAAAAAAAHHNHQQQQQHQQQQQQHHSHHQQLQLQQHLKSSAAAAAAAAAAAEFAASNHPFSITRLLPPPPTASAAAAASASDKPSSAASVAAATASSATAASAAEKMYEMAAASQYGTTAGYNDYYHPHAHPHHPHHHGHPHPHHQQASLYHAAAAAAAAAAAAAA

SEQ ID NO: 2677 - protein, 203 aa, Megachile rotundata
GTTGGGGVTYPGGAPGTTTGGGTYPGGVHGTTTGGGGTYPGGVPGTTTGGGGGTYPGGVPGTTTGGGGTYPGGVPGTTTGGGGTYPGGGGTYPGGVPGTVTTGGGGTYPGGVPGTVTTGGGGTYPGGVPGTTGGGGTYPGGMPGTTTGGGVTYPGGTPGTRIDGGAVYPPGIPGTTTGGGGTYPGGIPGTTTGGGVTYPGGVP

SEQ ID NO: 2678 - protein, 172 aa, Megachile rotundata
GGGTYPGGVPGTTTGGGVIYPGGVPGTTTGGGTYPGGVPGTTTGGGVIYPGGVPGTTTGGGTYPGGVPGTTTGGGVIYPGGVPGTTTGGGTYPGGVPGTTITGDARVYVGTIPSGGVVGGEVYPGKVPGSGVVYPGGVPDRTTSGGVIYPGGVPGTTTGGGTYPGGAPGTTT

SEQ ID NO: 2679 - protein, 180 aa, Acyrthosiphon pisum
GQNSEQSNEGQNSEQSNEVQSSEHSNEGQNSKQSNEGQNSEQSNEVQSSEHSNEGQNSEQSNEVQSSEHSNEGQNSKQSNEGQNSKQSNEVQSSEHWNEGQNSKQSNEDQNSEQSNEGQNSKQSNEGQNSKQSNEDQNSEQSNEGQNSKQSNEVQSSEQSNEGQNSKQSNEGQSSEQSNE

SEQ ID NO: 2680 - protein, 240 aa, Pseudomonas syringae
GYGSTQTAREGSNLTAGYGSTGTAGSDSSLIAGYGSTQTSGEDSSLTAGYGSTQTAQEGSNLTAGYGSTGTAGSDSSLIAGYGSTQTSGGDSSLTAGYGSTQTAQEGSNLTAGYGSTGTAGSDSSLIAGYGSTQTSGEDSSLTAGYGSTQTAQEGSNLTAGYGSTGTAGSDSSLIAGYGSTQTSGGDSSLTAGYGSTQTAQEGSNLTSGYGSTGTAGADSSLIAGYGSTQTSGSDSALTA

SEQ ID NO: 2681 - protein, 204 aa, Nematostella vectensis
GSGRMADSGGMAGSGRMADSGRMAGSGHMAGSGHMAGSGHMAGSGRMAGSGRMADSGGMAGSWRMAGSGRMAGSGRMAGSGRMAGSWRMAGSGRMAGSGRMAGSGHMAGSGDMAGSGCMAGSGRMAGSGHMAGSGRMVGSGHMVGSGRMAGSGGMAGSGRMAGSWRMAGSGRMAGSGRMAGSGHMAGSGDMAGSGCMAGSGRMA

SEQ ID NO: 2682 - protein, 216 aa, Dasypus novemcinctus
GVPPSAGVPPSAGVPPSADVPPSAGVSPSAGIPPSAGAPPSAGVLPSAGVPPSAGAPLSAGVLPSAGVPPSAGVPPSAGAPPSAGVPPSAGVSPSAGIPPSAGAPPSAGVLPSAGVPLSAGVPPSAGIPPSAGAPPSAGVPPSAGAPPSAGVPPSAGVPPSASVPPSADVPPSAGVSPSAGIPPSAGIPPSAGIPPSAGAPPSAGAPPSAGVPPSA

SEQ ID NO: 2683 - protein, 295 aa, Trichoderma harzianum
GEVYNSAKKTCSCPDGQYWNGKQCVCPYGQVFNGKQCVPDCGKEATFDYNQKKCVCKNKGEIYDSKTKTCSCPDGQVWNGKQCVCPYGQVFNGKQCVPDCGKDATYDYNQKKCVCKNKGEVFDQKTKTCSCPDGQYWNGKQCACPYGQIFNGKQCVPDCGKDATYDYNQKKCVCKNKGEVFDQKTKTCSCPDGQYWNGKQCVCPYGKIFDGKQCVEDCGKDAHFDNNQKKCVCNKNGEIYDSKSKTCSCPDSQYWDGSKCACPYGTVWDGKHCNQDCGKDAHFDSNQKKCVCNKQ

SEQ ID NO: 2684 - protein, 240 aa, Nematostella vectensis
GLWLCKANTRLRRQNGHCPPGLWLCKANTRLRRQNGHCPPGLWLCKANTRLRRQNGHCPPGLWLCKANTRLRRQNGHCPPGLWLCKANTRLRRQNGHCPPGLWLCKANTRLRRQNGHCPPGLWLCKANTRLRRQNGHCPPGLWLCKANTRLRRQNGHCPPGLWLCKANTRLRRQNGHCPPGLWLCKANTRLRRQNGHCPPGLWLCKANTRLRRQNGHCPPGLWLCKANTRLRRQNGHCPP

SEQ ID NO: 2685 - protein, 210 aa, Nematostella vectensis
GPWRSVGGSLGPWRSVEGSLGPWRSVGGSLSPWRSAEGSLGPWRSVGGSLGPWRSVGGSLGPWRSVEGSLGPWRSVGGSLSPWRSAEGSLGPWRSVGGSLGPWRSVGGSLGPWRSVGGSLGPWRSAEGSLGPWRSVGGSLGPWRSVGGSLGPWRSVGGSLGPWRSVEGSLGPWRSVGGSLGPWRSVGGSLGPWRSAEGSLGPWRSVGGSL

SEQ ID NO: 2686 - protein, 192 aa, Caenorhabditis elegans
GEESDNGEESDNEEASDNGEASDNGEESDNEEASDNGEESDNGEERGNGEASDNGDESDNGEASDNGEESDNEEASDNGEESDNGEESDNGEERGNGEASDNGDESDNGEASDNGEESDNEEASDNGEESDNGEASDNGEESDNEEASDNGEESDNGEASDNGEESDNGEERDNGEASDNGEESENGEEIGL

SEQ ID NO: 2687 - protein, 165 aa, Leishmania mexicana
GPLSVDPQSVGPLSVGSQSVGPQSVDPQSVGPLSVDPQSVGPLSVDPQSVDPQSVGPLSVDPQSVGPLSVDPQSVGPLSVGPLSVDPQSVGPQSVGPQSVGPLSVDPQSVGPQSVDPQSVGPLSVDPQSVGPLSVGPLSVDPQSVGPQSVGPQSVGPLSVDPQSV

SEQ ID NO: 2688 - protein, 256 aa, Chelonia mydas
GSPQAQEGAPGRSSAQGSTQAREGAPGRSSARGSPQAQEGAPGRSSAQGSTQAREGAPGRSSARGSPQAQEGAPGRSSAQGSTQAREGAPGRSSARGSPQAQEGAPGRSSAQGSTQAREGAPGRSSARGSPQAQEGAPGRSSAQGSTQAREGAPGRSSARGSPQAQEGAPGRSSAQGSTQAREGAPGRSSARGSPQAQEGAPGRSSAQGSTQAREGAPGRSSARGSPQAQEGAPGRSSAQGSTQAREGAPGRSSAR

SEQ ID NO: 2689 - protein, 202 aa, Nasonia vitripennis
GGGGPGTQFPGGVVYQPGTQVGGGGPGTQPSGGVLYPPGTQVGGGGPGTQFPDGVVYQPGTQVGGGGPGAQLPGAVLYPPGTQVIGGGGPGTQTPGGVVYQPGIQAGGGGPGAQAPGIVYQPGTQVGGGPGAPGGIVYQPGTKTVGGGPGAQAPGVVYQPGTQVGGGPGAPGGIVYQPGTQTGGGGPGAQAPGLIYQPGTQA

SEQ ID NO: 2690 - protein, 285 aa, Euprymna scolopes
GMNRFMNRYRPMFNNMYSNMYRGRYRGMMEPMSRMTMDFQGRYMDSQGRMVDPRYYDYYGRFNDYDRYYGRSMFNYGWMMDGDRYNRYNRWMDYPERYMDMSGYQMDMSGRWMDMQGRHCNPYSQWMMYNYNRHGYYPNYSYGRHMFYPERWMDMSNYSMDMYGRYMDRWGRYCNPFSQYMNYYGRYWNYPGYNNYYYSRNMYYPERYFDMSNWQMDMQGRWMDNQGRYCSPYWNNWYGRHMYYPYQNNYFYGRYDYPGMDYSNYQMDMQGRYMDQYGMNDYYYS

SEQ ID NO: 2691 - DNA, 2842 bp, Artificial Sequence
  Description of Artificial Sequence: Synthetic polynucleotide
ggcgcgcctaagcgatgactaggtctccaggtgagacggaaagtgaaacgtgatttcatgcgtcattttgaacattttgtaaatcttatttaataatgtgtgcggcaattcacatttaatttatgaatgttttcttaacatatcgcggcaactcaagaaacggcaggttcggatcttagctactagaccttaggaggtaaacatatgtcgtctggtgccaaattgtttgaaaatgaaatcccgtatgtcactgaactcgagggcgacgtcaatggtatgaagtttaccattcatggtaaaggtaccggcgatgcgagcgttggtaccattaaagcgcagttcatctgcactacgggcgacctgccggtcccgtgggcaaccctggtgagcaccctgagctacggtgttcagtgtttcgccaagtacccgccgcacatcaaggatttctacaagagctgcatgccggaaggttatgttcaagagcgtaccatcaccttcgaaggcgacggcgtgtttaagacgcgtgctgaggttacctttgaaaacggttctgtctacaatcgtgtcaaactgactggccagggttttaagaaagacggtcacattctgcgtaagaacgttgcattccaatgcccgccaagcattctgtatattctgcctgacaccgttaacaatggcatccgcgttgagttcaaccaggcgtacgatattgaaggtgtgaccgaaaaactggttaccaaatgcagccaaatgaatcgtccgttggcgggctccgcggcagtgcatatcccgcgttatcatcacctgagcaaacacaccaaactgagcaaagaccgcgacgagcgccgtgatcacatgtgtctggtagaggtcgtgaaagcggttgatctggacacgtatcagtaaggatctctccaaagcccgccgaaaggcgggcttttctgtcgtctcaaggtacgtcttcatcatcgctatcctgcaggcggatatcttcggaaaaaaaaaggcctgcgattaccagcaggcctgttgagatcgaggaaatctcgggatctagtcttgagctttgctcactcaaaggcggtaatgcggccgctagaaatattttatctgattaataagatgatcttcttgagatcgttttggtctgcgcgtaatctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgccaacatagtaagccagtatacactccgctagcgctgatgtccggcggtgcggtaccctggcagttccctactctcgcatggggtgaccccacactaccatcgggggccacaggcgcccacgaacccagttgacataagcctgttcggttcgtaaactgtaatgcaagtagcgtatgcgctcacgcaactggtccagaaccttgaccgaacgcagcggtggtaacggcgcagtggcggttttcatggcttgttatgactgtttttttgtacagtctatgcctcgggcatccaagcagcaagcgcgttacgccgtgggtcgatgtttgatgttatggagcagcaacgatgttacgcagcagggcagtcgccctaaaacaaagttaggtggctcaagtatgggcatcattcgcacatgtaggctcggccctgaccaagtcaaatccatgcgggctgctcttgatcttttcggtcgtgagttcggtgacgtagccacctactcccaacatcagccggactccgattacctcgggaacttgctccgtagtaagacattcattgcgcttgctgccttcgaccaagaagcggttgttggcgctctcgcggcttacgttctgcccaagtttgagcagccgcgtagtgagatatatatctatgatctcgcagtctccggagagcaccggaggcagggcattgccaccgcgctcatcaatctcctcaagcatgaggccaacgcgcttggtgcttatgtgatctacgtgcaagcagattacggtgacgatcccgcagtggctctctatacaaagttgggcatacgggaagaagtgatgcactttgatatcgacccaagtaccgccacctaacaattcgttcaagctcgaggtatcacgaggcagaatttcagataaaaaaaatccttagctttcgctaaggat

SEQ ID NO: 2692 - DNA, 3999 bp, Artificial Sequence
  Description of Artificial Sequence: Synthetic polynucleotide
ggcgcgcctaagcgatgactaggtctccaggtgagacggaaagtgaaacgtgatttcatgcgtcattttgaacattttgtaaatcttatttaataatgtgtgcggcaattcacatttaatttatgaatgttttcttaacatatcgcggcaactcaagaaacggcaggttcggatcttagctactagaccttaggaggtaaacatatgtcgtctggtgccaaattgtttgaaaatgaaatcccgtatgtcactgaactcgagggcgacgtcaatggtatgaagtttaccattcatggtaaaggtaccggcgatgcgagcgttggtaccattaaagcgcagttcatctgcactacgggcgacctgccggtcccgtgggcaaccctggtgagcaccctgagctacggtgttcagtgtttcgccaagtacccgccgcacatcaaggatttctacaagagctgcatgccggaaggttatgttcaagagcgtaccatcaccttcgaaggcgacggcgtgtttaagacgcgtgctgaggttacctttgaaaacggttctgtctacaatcgtgtcaaactgactggccagggttttaagaaagacggtcacattctgcgtaagaacgttgcattccaatgcccgccaagcattctgtatattctgcctgacaccgttaacaatggcatccgcgttgagttcaaccaggcgtacgatattgaaggtgtgaccgaaaaactggttaccaaatgcagccaaatgaatcgtccgttggcgggctccgcggcagtgcatatcccgcgttatcatcacctgagcaaacacaccaaactgagcaaagaccgcgacgagcgccgtgatcacatgtgtctggtagaggtcgtgaaagcggttgatctggacacgtatcagtaaggatctctccaaagcccgccgaaaggcgggcttttctgtcgtctcaaggtacgtcttcatcatcgctatcctgcaggcggatatcttcggaaaaaaaaaggcctgcgattaccagcaggcctgttgagatcgaggaaatctcgggatctagtcttgagctttgctcactcaaaggcggtaatgcggccgctagaaatattttatctgattaataagatgatcttcttgagatcgttttggtctgcgcgtaatctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgccaacatagtaagccagtatacactccgctagcgctgatgtccggcggtgcggtaccctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctccaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgcctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggagctagttcatgaccaaaatcccttaacgtctagacttgaagactgacgtcgagacctacgaattcttgatcgggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatccctctggagtgaataccacgacgatttccggcagtttctacacatatattcgcaagatgtggcgtgttacggtgaaaacctggcctatttccctaaagggtttattgagaatatgtttttcgtgtcagccaatccctgggtgagtttcaccagttttgatttaaacgtggccaatatggacaacttcttcgcccccgttttcacgatgggcaaatattatacgcaaggcgacaaggtgctgatgccgctggcgattcaggttcatcatgccgtttgtgatggcttccatgtcggcagaatgcttaatgaattacaacagtactgtgatgagtggcagggcggggcgtaatttgatatcgagctcgcttggactcctgttgatagatccagtaatgacctcagaactccatctggatttgttcagaacgctcggttgccgccgggcgttttttattggtgagaatccaagcctcctcgaggtatcacgaggcagaatttcagataaaaaaaatccttagctttcgctaaggat

SEQ ID NO: 2693 - DNA, 4026 bp, Artificial Sequence
  Description of Artificial Sequence: Synthetic polynucleotide
ggcgcgcctaagcgatgactaggtctccaggtgagacggaaagtgaaacgtgatttcatgcgtcattttgaacattttgtaaatcttatttaataatgtgtgcggcaattcacatttaatttatgaatgttttcttaacatatcgcggcaactcaagaaacggcaggttcggatcttagctactagaccttaggaggtaaacatatgtcgtctggtgccaaattgtttgaaaatgaaatcccgtatgtcactgaactcgagggcgacgtcaatggtatgaagtttaccattcatggtaaaggtaccggcgatgcgagcgttggtaccattaaagcgcagttcatctgcactacgggcgacctgccggtcccgtgggcaaccctggtgagcaccctgagctacggtgttcagtgtttcgccaagtacccgccgcacatcaaggatttctacaagagctgcatgccggaaggttatgttcaagagcgtaccatcaccttcgaaggcgacggcgtgtttaagacgcgtgctgaggttacctttgaaaacggttctgtctacaatcgtgtcaaactgactggccagggttttaagaaagacggtcacattctgcgtaagaacgttgcattccaatgcccgccaagcattctgtatattctgcctgacaccgttaacaatggcatccgcgttgagttcaaccaggcgtacgatattgaaggtgtgaccgaaaaactggttaccaaatgcagccaaatgaatcgtccgttggcgggctccgcggcagtgcatatcccgcgttatcatcacctgagcaaacacaccaaactgagcaaagaccgcgacgagcgccgtgatcacatgtgtctggtagaggtcgtgaaagcggttgatctggacacgtatcagtaaggatctctccaaagcccgccgaaaggcgggcttttctgtcgtctcaaggtacgtcttcatcatcgctatcctgcaggcggatatcttcggaaaaaaaaaggcctgcgattaccagcaggcctgttgagatcgaggaaatctcgggatctagtcttgagctttgctcactcaaaggcggtaatgcggccgctagaaatattttatctgattaataagatgatcttcttgagatcgttttggtctgcgcgtaatctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgccaacatagtaagccagtatacactccgctagcgctgatgtccggcggtgcggtaccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtcgcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttctagacttgaagactgacgtcgagacctacgaattcttgatcgggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatccctctggagtgaataccacgacgatttccggcagtttctacacatatattcgcaagatgtggcgtgttacggtgaaaacctggcctatttccctaaagggtttattgagaatatgtttttcgtgtcagccaatccctgggtgagtttcaccagttttgatttaaacgtggccaatatggacaacttcttcgcccccgttttcacgatgggcaaatattatacgcaaggcgacaaggtgctgatgccgctggcgattcaggttcatcatgccgtttgtgatggcttccatgtcggcagaatgcttaatgaattacaacagtactgtgatgagtggcagggcggggcgtaatttgatatcgagctcgcttggactcctgttgatagatccagtaatgacctcagaactccatctggatttgttcagaacgctcggttgccgccgggcgttttttattggtgagaatccaagcctcctcgaggtatcacgaggcagaatttcagataaaaaaaatccttagctttcgctaaggat

SEQ ID NO: 2694 - DNA, 4185 bp, Artificial Sequence
  Description of Artificial Sequence: Synthetic polynucleotide
ggcgcgcctaagcgatgactaggtctccaggtgagacggaaagtgaaacgtgatttcatgcgtcattttgaacattttgtaaatcttatttaataatgtgtgcggcaattcacatttaatttatgaatgttttcttaacatatcgcggcaactcaagaaacggcaggttcggatcttagctactagaccttaggaggtaaacatatgtcgtctggtgccaaattgtttgaaaatgaaatcccgtatgtcactgaactcgagggcgacgtcaatggtatgaagtttaccattcatggtaaaggtaccggcgatgcgagcgttggtaccattaaagcgcagttcatctgcactacgggcgacctgccggtcccgtgggcaaccctggtgagcaccctgagctacggtgttcagtgtttcgccaagtacccgccgcacatcaaggatttctacaagagctgcatgccggaaggttatgttcaagagcgtaccatcaccttcgaaggcgacggcgtgtttaagacgcgtgctgaggttacctttgaaaacggttctgtctacaatcgtgtcaaactgactggccagggttttaagaaagacggtcacattctgcgtaagaacgttgcattccaatgcccgccaagcattctgtatattctgcctgacaccgttaacaatggcatccgcgttgagttcaaccaggcgtacgatattgaaggtgtgaccgaaaaactggttaccaaatgcagccaaatgaatcgtccgttggcgggctccgcggcagtgcatatcccgcgttatcatcacctgagcaaacacaccaaactgagcaaagaccgcgacgagcgccgtgatcacatgtgtctggtagaggtcgtgaaagcggttgatctggacacgtatcagtaaggatctctccaaagcccgccgaaaggcgggcttttctgtcgtctcaaggtacgtcttcatcatcgctatcctgcaggcggatatcttcggaaaaaaaaaggcctgcgattaccagcaggcctgttgagatcgaggaaatctcgggatctagtcttgagctttgctcactcaaaggcggtaatgcggccgctagaaatattttatctgattaataagatgatcttcttgagatcgttttggtctgcgcgtaatctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgccaacatagtaagccagtatacactccgctagcgctgatgtccggcggtgcggtaccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtcgcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttctagacttgaagactgacgtcgagacctacgaattcctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctccaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgcctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggagctagttcatgaccaaaatcccttaacgctcgaggtatcacgaggcagaatttcagataaaaaaaatccttagctttcgctaaggat

SEQ ID NO: 2695 - DNA, 4185 bp, Artificial Sequence
  Description of Artificial Sequence: Synthetic polynucleotide
ggcgcgcctaagcgatgactaggtctccaggtgagacggaaagtgaaacgtgatttcatgcgtcattttgaacattttgtaaatcttatttaataatgtgtgcggcaattcacatttaatttatgaatgttttcttaacatatcgcggcaactcaagaaacggcaggttcggatcttagctactagaccttaggaggtaaacatatgtcgtctggtgccaaattgtttgaaaatgaaatcccgtatgtcactgaactcgagggcgacgtcaatggtatgaagtttaccattcatggtaaaggtaccggcgatgcgagcgttggtaccattaaagcgcagttcatctgcactacgggcgacctgccggtcccgtgggcaaccctggtgagcaccctgagctacggtgttcagtgtttcgccaagtacccgccgcacatcaaggatttctacaagagctgcatgccggaaggttatgttcaagagcgtaccatcaccttcgaaggcgacggcgtgtttaagacgcgtgctgaggttacctttgaaaacggttctgtctacaatcgtgtcaaactgactggccagggttttaagaaagacggtcacattctgcgtaagaacgttgcattccaatgcccgccaagcattctgtatattctgcctgacaccgttaacaatggcatccgcgttgagttcaaccaggcgtacgatattgaaggtgtgaccgaaaaactggttaccaaatgcagccaaatgaatcgtccgttggcgggctccgcggcagtgcatatcccgcgttatcatcacctgagcaaacacaccaaactgagcaaagaccgcgacgagcgccgtgatcacatgtgtctggtagaggtcgtgaaagcggttgatctggacacgtatcagtaaggatctctccaaagcccgccgaaaggcgggcttttctgtcgtctcaaggtacgtcttcatcatcgctatcctgcaggcggatatcttcggaaaaaaaaaggcctgcgattaccagcaggcctgttgagatcgaggaaatctcgggatctagtcttgagctttgctcactcaaaggcggtaatgcggccgctagaaatattttatctgattaataagatgatcttcttgagatcgttttggtctgcgcgtaatctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgccaacatagtaagccagtatacactccgctagcgctgatgtccggcggtgcggtaccctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctccaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgcctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggagctagttcatgaccaaaatcccttaacgtctagacttgaagactgacgtcgagacctacgaattcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtcgcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatccttctcgaggtatcacgaggcagaatttcagataaaaaaaatccttagctttcgctaaggat

SEQ ID NO: 2696 - DNA, 2801 bp, Artificial Sequence
  Description of Artificial Sequence: Synthetic polynucleotide
ggcgcgcctaagcgatggtctcaaggagagacgtgaaagtgaaacgtgatttcatgcgtcattttgaacattttgtaaatcttatttaataatgtgtgcggcaattcacatttaatttatgaatgttttcttaacatatcgcggcaactcaagaaacggcaggttcggatcttagctactagagattaaggaggtaaaaaaaatgagtgtgatcgctaaacaaatgacctacaaggtttatatgtcaggcacggtcaatggacactactttgaggtcgaaggtgatggaaaaggtaagccctacgagggggagcagacggtaaagctcactgtcaccaagggcggacctctgccatttgcttgggatattttatcaccacagtgtcagtacggaagcataccattcaccaagtaccctgaagatatccctgactatgtaaagcagtcattcccggagggctatacatgggagaggatcatgaactttgaagatggtgcagtgtgtactgtcagcaatgattccagcatccaaggcaactgtttcatctaccatgtcaagttctctggtttgaactttcctcccaatggacctgtcatgcagaagaaaacacagggctgggaacccaacactgagcgtctgtttgcacgagatggaatgctgctaggaaacaactttatggctctgaagttagaaggaggcggtcactatttgtgtgaatttaaaactacttacaaggcaaagaagcctgtgaagatgccagggtatcactatgttgaccgcaaactggatgtaaccaatcacaacaaggattacacttcggttgagcagtgtgaaatttccattgcacgcaaacctgtggtcgcctaaggatctctccaaagcccgccgaaaggcgggcttttctgtcgtctcaaggtacgtcttcatcgctatcctgcaggcggatatcttcggaaaaaaaaaggcctgcgattaccagcaggcctgttgagatcgaggaaatctcgggatctagtcttgagctttgctcactcaaaggcggtaatgcggccgctagaaatattttatctgattaataagatgatcttcttgagatcgttttggtctgcgcgtaatctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgccaacatagtaagccagtatacactccgctagcgctgatgtccggcggtgcggtaccctggcagttccctactctcgcatggggtgaccccacactaccatcgggggccacaggcgcccacgaacccagttgacataagcctgttcggttcgtaaactgtaatgcaagtagcgtatgcgctcacgcaactggtccagaaccttgaccgaacgcagcggtggtaacggcgcagtggcggttttcatggcttgttatgactgtttttttgtacagtctatgcctcgggcatccaagcagcaagcgcgttacgccgtgggtcgatgtttgatgttatggagcagcaacgatgttacgcagcagggcagtcgccctaaaacaaagttaggtggctcaagtatgggcatcattcgcacatgtaggctcggccctgaccaagtcaaatccatgcgggctgctcttgatcttttcggtcgtgagttcggtgacgtagccacctactcccaacatcagccggactccgattacctcgggaacttgctccgtagtaagacattcattgcgcttgctgccttcgaccaagaagcggttgttggcgctctcgcggcttacgttctgcccaagtttgagcagccgcgtagtgagatatatatctatgatctcgcagtctccggagagcaccggaggcagggcattgccaccgcgctcatcaatctcctcaagcatgaggccaacgcgcttggtgcttatgtgatctacgtgcaagcagattacggtgacgatcccgcagtggctctctatacaaagttgggcatacgggaagaagtgatgcactttgatatcgacccaagtaccgccacctaacaattcgttcaagctcgaggtatcacgaggcagaatttcagataaaaaaaatccttagctttcgctaaggat

SEQ ID NO: 2697 - DNA, 6574 bp, Artificial Sequence
  Description of Artificial Sequence: Synthetic polynucleotide
gcgatcgcggtctcactatccagaaaacggaacagattatggaattagtcaaaccaattgtcgacaatgttcgtcaaaatggtgacaaagcccttttagaactaactgccaagtttgatggagtcgctttgaagacacctgtgttagaagctcctttcccagaggaacttatgcaattgccagataacgttaagagagccattgatctctctatagataacgtcaggaaattccatgaagctcaactaacggagacgttgcaagttgagacttgccctggtgtagtctgctctcgttttgcaagacctattgagaaagttggcctctatattcctggtggaaccgcaattctgccttccacttccctgatgctgggtgttcctgccaaagttgctggttgcaaagaaattgtttttgcatctccacctaagaaggatggtacccttaccccagaagtcatctacgttgcccacaaggttggtgctaagtgtatcgtgctagcaggaggcgcccaggcagtagctgctatggcttacggaacagaaactgttcctaagtgtgacaaaatatttggtccaggaaaccagttcgttactgctgccaagatgatggttcaaaatgacacatcagccctgtgtagtattgacatgcctgctgggccttctgaagttctagttattgctgataaatacgctgatccagatttcgttgcctcagaccttctgtctcaagctgaacatggtattgattcccaggtgattctgttggctgtcgatatgacagacaaggagcttgccagaattgaagatgctgttcacaaccaagctgtgcagttgccaagggttgaaattgtacgcaagtgtattgcacactctacaaccctatcggttgcaacctacgagcaggctttggaaatgtccaatcagtacgctcctgaacacttgatcctgcaaatcgagaatgcttcttcttatgttgatcaagtacaacacgctggatctgtgtttgttggtgcctactctccagagagttgtggagattactcctccggtaccaaccacactttgccaacgtacggatatgcccgtcaatacagcggagttaacactgcaaccttccagaagttcatcacttcacaagacgtaactcctgagggactgaaacatattggccaagcagtgatggatctggctgctgttgaaggtctagatgctcaccgcaatgctgttaaggttcgtatggagaaactgggacttatttaattatttagagattttaacttacatttagattcgatagatctaaccggcatctaacatccagtgtttctaatctagtgaatcgagatcaagtctcactctgaacataataaataaggtctaaccccatggaattacatgtccccttgggttctgagattgtcttacccggtggggaaagagccatactcaagttcgtaggaaatgtggagtcaaagtctgggatttttgctggtgttgaactgattggtcaaatgagtggaaaaggaaacctcagcttttttgtagaaatgtcttggtgtcctcgtccaatcaggtagccatctctgaaatatctggctccgttgcaactccgaacgacctgctggcaacgtaaaattctccggggtaaaacttaaatgtggagtaatggaaccagaaacgtctcttcccttctctctccttccaccgcccgttaccgtccctaggaaattttactctgctggagagcttcttctacggcccccttgcagcaatgctcttcccagcattacgttgcgggtaaaacggaggtcgtgtacccgacctagcagcccagggatggaaaagtcccggccgtcgctggcaataatagcgggcggacgcatgtcatgagattattggaaaccaccagaatcgaatataaaaggcgaacacctttcccaattttggtttctcctgacccaaagactttaaatttaatttatttgtccctatttcaatcaattgaacaactatcaggcgcgccgaaacgatgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaaggtatcgctcatcgcgaaagtgaaacgtgatttcatgcgtcattttgaacattttgtaaatcttatttaataatgtgtgcggcaattcacatttaatttatgaatgttttcttaacatatcgcggcaactcaagaaacggcaggttcggatcttagctactagagattaaggaggtaaaaaaaatgagtgtgatcgctaaacaaatgacctacaaggtttatatgtcaggcacggtcaatggacactactttgaggtcgaaggtgatggaaaaggtaagccctacgagggggagcagacggtaaagctcactgtcaccaagggcggacctctgccatttgcttgggatattttatcaccacagtgtcagtacggaagcataccattcaccaagtaccctgaagatatccctgactatgtaaagcagtcattcccggagggctatacatgggagaggatcatgaactttgaagatggtgcagtgtgtactgtcagcaatgattccagcatccaaggcaactgtttcatctaccatgtcaagttctctggtttgaactttcctcccaatggacctgtcatgcagaagaaaacacagggctgggaacccaacactgagcgtctctttgcacgagatggaatgctgctaggaaacaactttatggctctgaagttagaaggaggcggtcactatttgtgtgaatttaaaactacttacaaggcaaagaagcctgtgaagatgccagggtatcactatgttgaccgcaaactggatgtaaccaatcacaacaaggattacacttcggttgagcagtgtgaaatttccattgcacgcaaacctgtggtcgcctaaggatctctccaaagcccgccgaaaggcgggcttttctgtgcgatgttgctgacagaggtgactacaaagatgacgacgataaagattacaaagacgatgacgataaggactataaagatgatgacgacaaataataacctgcaggagacatgactgttcctcagttcaagttgggcacttacgagaagaccggtcttgctagattctaatcaagaggatgtcagaatgccatttgcctgagagatgcaggcttcatttttgattacttttttatttgtaacctatatagtataggattttttttgtcattttgtttcttctcgtacgagcttgctcctgatcagcctatctcgcagctgatgaatatcttgtggtaggggtttgggaaaatcattcgagtttgatgtttttcttggtatttcccactcctcttcagagtacagaagattaagtgagaggatccctggaccacaggtatctgatgcggccgcgcaaagttggtagatgtgacttccactgttgcttctggtataatccccattattgatgctcggcaattgactactgaatacgaactttctgaagatgtcaaaaagttccctgtcagtgaaattttgttggcgtctttgactactgaccgccccgatggtctattcactactttggtggctgactcttctaattactcgttgggcctggtgtactcgtccaaaaagtctattccggaggctataaggacacaaactggagtctaccaatctcgtcgtcacggtttgtggtataaaggtgctacatctggagcaactcaaaagttgctgggtatcgaattggattgtgatggagactgcttgaaatttgtggttgaacaaacaggtgttggtttctgtcacttggaacgcacttcctgttttggccaatcaaagggtcttagagccatggaagccaccttgtgggatcgtaagagcaatgctccagaaggttcttataccaaacggttatttgacgacgaagttttgttgaacgctaaaattagggaggaagctgatgaacttgcagaagctaaatccaaggaagatatagcctgggaatgtgctgacttattttattttgcattagttagatgtgccaagtacggtgtgacgttggacgaggtggagagaaacctggatatgaagtccctaaaggtcactagaaggaaaggagatgccaagccaggatacaccaaggaacaacctaaagaagaatccaaacctaaagaagtcccttctgaaggtcgtattgaattgtgcaaaattgacgtttctaaggcctcctcacaagaaattgaagatgcccttcgtcgtcctatagagaccttaattaagcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaagacgtcccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggtgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataactgtcagaccaagtttactcatatatactttagattgatttaaaacttcatttttaatttaaaaggatctaggtgaagatcctt

SEQ ID NO: 2698 - DNA, 7407 bp, Artificial Sequence
  Description of Artificial Sequence: Synthetic polynucleotide
gcgatcgcggtctcagacacttcaaaaccgttttggatcattcctctcttctcggattcagagtagtctaacttgaaagttgaagtgttactccaatacgagaaaggtctattggccagataaacaaccaggggaggaatgtgatccgtgccttcaacaatgtctgtcaaatttctagcatcacaaccaaagaaggttggcttactcgaaagattcaagtttaggaaagtggtggtatcaggtacataagggaacgttgttccatttgcttgagaagaaaactgtctcatgtaggtgttgactaatgatgaaccgtttggccaagagaggtcagtgtctgcactgttgtcaaacgcaaagatgatatcaacgtcacgctccttttgaagtagaggctgcagagggacgttttggttatcctctccaccatcaaccaagtaaagggtgtcattttccgcaatggcacctactcctgcatacgtacttttgtagaaagggttgggggaatagatagcaatgtcgtcttcgtcttcgctaagtccagtcagaaaatgctcaatgatttggtaaattgctcctgaaagatcactcgtattcagttgcagaataaactgattaaacaacgaggatgaagttcccagcacgaaaccagtgttgtcaaatccagcaatgcaaccacgctcatcatctgcgttatttggaacaccattggtaacgttagtaccaagatatgtcaaatcagtaaacccgtacactgaacctcagcttttttgtagaaatgtcttggtgtcctcgtccaatcaggtagccatctctgaaatatctggctccgttgcaactccgaacgacctgctggcaacgtaaaattctccggggtaaaacttaaatgtggagtaatggaaccagaaacgtctcttcccttctctctccttccaccgcccgttaccgtccctaggaaattttactctgctggagagcttcttctacggcccccttgcagcaatgctcttcccagcattacgttgcgggtaaaacggaggtcgtgtacccgacctagcagcccagggatggaaaagtcccggccgtcgctggcaataatagcgggcggacgcatgtcatgagattattggaaaccaccagaatcgaatataaaaggcgaacacctttcccaattttggtttctcctgacccaaagactttaaatttaatttatttgtccctatttcaatcaattgaacaactatcaggcgcgccgaaacgatgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaaggtatcgctcatcgcgaaagtgaaacgtgatttcatgcgtcattttgaacattttgtaaatcttatttaataatgtgtgcggcaattcacatttaatttatgaatgttttcttaacatatcgcggcaactcaagaaacggcaggttcggatcttagctactagagattaaggaggtaaaaaaaatgagtgtgatcgctaaacaaatgacctacaaggtttatatgtcaggcacggtcaatggacactactttgaggtcgaaggtgatggaaaaggtaagccctacgagggggagcagacggtaaagctcactgtcaccaagggcggacctctgccatttgcttgggatattttatcaccacagtgtcagtacggaagcataccattcaccaagtaccctgaagatatccctgactatgtaaagcagtcattcccggagggctatacatgggagaggatcatgaactttgaagatggtgcagtgtgtactgtcagcaatgattccagcatccaaggcaactgtttcatctaccatgtcaagttctctggtttgaactttcctcccaatggacctgtcatgcagaagaaaacacagggctgggaacccaacactgagcgtctctttgcacgagatggaatgctgctaggaaacaactttatggctctgaagttagaaggaggcggtcactatttgtgtgaatttaaaactacttacaaggcaaagaagcctgtgaagatgccagggtatcactatgttgaccgcaaactggatgtaaccaatcacaacaaggattacacttcggttgagcagtgtgaaatttccattgcacgcaaacctgtggtcgcctaaggatctctccaaagcccgccgaaaggcgggcttttctgtgcgatgttgctgacagaggtgactacaaagatgacgacgataaagattacaaagacgatgacgataaggactataaagatgatgacgacaaataataacctgcaggagacatgactgttcctcagttcaagttgggcacttacgagaagaccggtcttgctagattctaatcaagaggatgtcagaatgccatttgcctgagagatgcaggcttcatttttgattacttttttatttgtaacctatatagtataggattttttttgtcattttgtttcttctcgtacgagcttgctcctgatcagcctatctcgcagctgatgaatatcttgtggtaggggtttgggaaaatcattcgagtttgatgtttttcttggtatttcccactcctcttcagagtacagaagattaagtgagaggatccttcagtaatgtcttgtttcttttgttgcagtggtgagccattttgacttcgtgaaagtttctttagaatagttgtttccagaggccaaacattccacccgtagtaaagtgcaagcgtaggaagaccaagactggcataaatcaggtataagtgtcgagcactggcaggtgatcttctgaaagtttctactagcagataagatccagtagtcatgcatatggcaacaatgtaccgtgtggatctaagaacgcgtcctactaaccttcgcattcgttggtccagtttgttgttatcgatcaacgtgacaaggttgtcgattccgcgtaagcatgcatacccaaggacgcctgttgcaattccaagtgagccagttccaacaatctttgtaatattagagcacttcattgtgttgcgcttgaaagtaaaatgcgaacaaattaagagataatctcgaaaccgcgacttcaaacgccaatatgatgtgcggcacacaataagcgttcatatccgctgggtgactttctcgctttaaaaaattatccgaaaaaatttttgacggctagctcagtcctaggtacgctagcattaaagaggagaaaatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatcccagggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaacacgtccgacggcggcccacgggtcccaggcctcggagatccgtcccccttttcctttgtcgatatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcaagctgcggccgcacatggcactgtctgggaacctgttccattggtccaagagagggttccaagatcgtcaaatggggtggtgttttggatcacagatctaacgtttacggagtcaagggcctgaaggttggtgacttgtccgtctgtccagacaatgttggttgtaacacctacaccaccgctcttttgatcggtgaaaagactgccaccttggttggtgaagacttaggatacacaggtgaggccttagacatgactgtacctcagttcaagttgggcacttacgagaagactggtcttgctagattctagtttatgttgtatctatgaatatttttttacatggtggatttgttccaatctagttgttagttatttgtcgttatagtcactaatacagttaccatcggaatcttttcatttctttttatacgtacgtatatgtactagatgaagaatgcgacaaggccgaccaacagcaatggtgcttggtaccaaagtttggaaggtgctaccgaattggccgatgatattgaagtggagttgtcattctcctcattggttgctccagtagtggtaaaattaacggggatatcttcggtggaagtgtcaatatcaccgttccaacaataattctcaaaacatcttctacattgctctgtttgtgttgcattggatctctcctgctgtctacgaatgattgcacatccaacacaagtacgccattcttcatcaatagtcatgttcaaacgagacgacaagagaccttaattaagcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaagacgtcccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggtgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataactgtcagaccaagtttactcatatatactttagattgatttaaaacttcatttttaatttaaaaggatctaggtgaagatcctt

SEQ ID NO: 2699 - DNA, 7098 bp, Artificial Sequence
  Description of Artificial Sequence: Synthetic polynucleotide
gcgatcgcggtctcacagatgacagagttgtcaagaacttgaccactttgttgttcgacacagctttgttgacttccggtttcactttggatgagccaacttctttcgctgccagaatcaacggtttgatctccattggtttgaacatcgatgaggaggaagagaaagagccagaacaggctactgaagctccaagtgaagaagctgttgctgagtctgccatggaggaggttgactagttgaatttaggtatatatagtgactgtgatatttagctaatgaaatctaattggatatttagaatgcctcatctcgtagcctatcaattactattaggccatctcttatgggcccttctttgaaattgcattcaaggggggatgggactattttgaatttgaagtttggactctgtgagctgtttggccaattgaagtcatccacttgtacacagggattcaccagtagtttagaacaattctctatcgttattctcttgtcgtctttggcaatacaagcgtcgatgactgagttggtgactttatgaagtctaagttgatatgagtttgaaattatgaaacagttttttacactggacatgtagatagggcccttgatgtttaggaagaggatacagtttgagatgttggagatgtgtgtggagggagcgaccacttttaaaaccacatgatccagacgttgctcagttatcgaagtttcggaaacaacctcagcttttttgtagaaatgtcttggtgtcctcgtccaatcaggtagccatctctgaaatatctggctccgttgcaactccgaacgacctgctggcaacgtaaaattctccggggtaaaacttaaatgtggagtaatggaaccagaaacgtctcttcccttctctctccttccaccgcccgttaccgtccctaggaaattttactctgctggagagcttcttctacggcccccttgcagcaatgctcttcccagcattacgttgcgggtaaaacggaggtcgtgtacccgacctagcagcccagggatggaaaagtcccggccgtcgctggcaataatagcgggcggacgcatgtcatgagattattggaaaccaccagaatcgaatataaaaggcgaacacctttcccaattttggtttctcctgacccaaagactttaaatttaatttatttgtccctatttcaatcaattgaacaactatcaggcgcgccgaaacgatgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaaggtatcgctcatcgcgaaagtgaaacgtgatttcatgcgtcattttgaacattttgtaaatcttatttaataatgtgtgcggcaattcacatttaatttatgaatgttttcttaacatatcgcggcaactcaagaaacggcaggttcggatcttagctactagagattaaggaggtaaaaaaaatgagtgtgatcgctaaacaaatgacctacaaggtttatatgtcaggcacggtcaatggacactactttgaggtcgaaggtgatggaaaaggtaagccctacgagggggagcagacggtaaagctcactgtcaccaagggcggacctctgccatttgcttgggatattttatcaccacagtgtcagtacggaagcataccattcaccaagtaccctgaagatatccctgactatgtaaagcagtcattcccggagggctatacatgggagaggatcatgaactttgaagatggtgcagtgtgtactgtcagcaatgattccagcatccaaggcaactgtttcatctaccatgtcaagttctctggtttgaactttcctcccaatggacctgtcatgcagaagaaaacacagggctgggaacccaacactgagcgtctctttgcacgagatggaatgctgctaggaaacaactttatggctctgaagttagaaggaggcggtcactatttgtgtgaatttaaaactacttacaaggcaaagaagcctgtgaagatgccagggtatcactatgttgaccgcaaactggatgtaaccaatcacaacaaggattacacttcggttgagcagtgtgaaatttccattgcacgcaaacctgtggtcgcctaaggatctctccaaagcccgccgaaaggcgggcttttctgtgcgatgttgctgacagaggtgactacaaagatgacgacgataaagattacaaagacgatgacgataaggactataaagatgatgacgacaaataataacctgcaggagacatgactgttcctcagttcaagttgggcacttacgagaagaccggtcttgctagattctaatcaagaggatgtcagaatgccatttgcctgagagatgcaggcttcatttttgattacttttttatttgtaacctatatagtataggattttttttgtcattttgtttcttctcgtacgagcttgctcctgatcagcctatctcgcagctgatgaatatcttgtggtaggggtttgggaaaatcattcgagtttgatgtttttcttggtatttcccactcctcttcagagtacagaagattaagtgagaggatccttcagtaatgtcttgtttcttttgttgcagtggtgagccattttgacttcgtgaaagtttctttagaatagttgtttccagaggccaaacattccacccgtagtaaagtgcaagcgtaggaagaccaagactggcataaatcaggtataagtgtcgagcactggcaggtgatcttctgaaagtttctactagcagataagatccagtagtcatgcatatggcaacaatgtaccgtgtggatctaagaacgcgtcctactaaccttcgcattcgttggtccagtttgttgttatcgatcaacgtgacaaggttgtcgattccgcgtaagcatgcatacccaaggacgcctgttgcaattccaagtgagccagttccaacaatctttgtaatattagagcacttcattgtgttgcgcttgaaagtaaaatgcgaacaaattaagagataatctcgaaaccgcgacttcaaacgccaatatgatgtgcggcacacaataagcgttcatatccgctgggtgactttctcgctttaaaaaattatccgaaaaaatttttgacggctagctcagtcctaggtacgctagcattaaagaggagaaaatgactactcttgatgacacagcctacagatataggacatcagttccgggtgacgcagaggctatcgaagccttggacggttcattcactactgatacggtgtttagagtcaccgctacaggtgatggcttcaccttgagagaggttcctgtagacccacccttaacgaaagttttccctgatgacgaatcggatgacgagtctgatgctggtgaggacggtgaccctgattccagaacatttgtcgcatacggagatgatggtgacctggctggctttgttgtggtgtcctacagcggatggaatcgtagactcacagttgaggacatcgaagttgcacctgaacatcgtggtcacggtgttggtcgtgcactgatgggactggcaacagagtttgctagagaaagaggagccggacatttgtggttagaagtgaccaatgtcaacgctcctgctattcacgcatataggcgaatgggtttcactttgtgcggtcttgatactgctttgtatgacggaactgcttctgatggtgaacaagctctttacatgagtatgccatgtccatagcacgtccgacggcggcccacgggtcccaggcctcggagatccgtcccccttttcctttgtcgatatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcaagctgcggccgcaagaagttgattgagactttcaacgagattgctgaagacaaggaacaattcgagaagttttacagtgctttctccaagaacttgaagttgggtgtccatgaagacagccaaaacagatccgcattggccaagttgctgagatttaactccaccaagtctactgaggagctaacctcattctctgactacgtcaccagaatgccagagcaccagaagaacatctacttcattaccggtgagtctgtcaaggctcttgagaaatctccattcttggatgctttgaaggagaagaactttgaggtcctattgctgaccgatcctattgatgagtacgctatgactcaattgaaagagattgaggacaagaaattggttgacatcactaaagactttgagctggaagagtctgaggaggagaagaaggctagagaggaagaggttaaagatttcgagcctttgactaaagccctgaaagagattttgggtgacaaggttgagaaggttgtagtttcctacaagctggttgactctcctgctgctattagaacttcccaattcggctggtctgctaacatggaaagaattatgaaggctcaagctctgagagacaccaacaccatgtcctcgtacatggcttcaaagaagatcttcgagatctctccaaagtcgccaatcattaaggctttgagaaagaaggttgaggctaccggtacagaagagaccttaattaagcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaagacgtcccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggtgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataactgtcagaccaagtttactcatatatactttagattgatttaaaacttcatttttaatttaaaaggatctaggtgaagatcctt

SEQ ID NO: 2700 - DNA, 7382 bp, Artificial Sequence
  Description of Artificial Sequence: Synthetic polynucleotide
gcgatcgcggtctcatgatatatttgtattttgttcgttaacattgatgttttcttcatttactgttattgtttgtaactttgatcgatttatcttttctactttactgtaatatggctggcgggtgagccttgaactccctgtattactttaccttgctattacttaatctattgactagcagcgacctcttcaaccgaagggcaagtacacagcaagttcatgtctccgtaagtgtcatcaaccctggaaacagtgggccatgtcttttgctccttcaaaaatggcaatgggtaggctgcctcctctcttgtgtatcctctctgggaccactcagcgtcacttgtgctaataatatcttttaggttgtgtggggagttgtgcaagattgcaccatctgtttctccgttttctactttacggatttcttctctaatagagatcatagagtcaatgaatctgtctaattcttctttgtattcggattcagttggttctaccatcaatgtgcccggaatagggaacgacatggtaggagcatggaatccataatcttgcagacgcttggccacatcaatggcctcaattccgaatttcttgaatggtctaagatcaataatgaactcatggccacagtacttgtcctcagcttttttgtagaaatgtcttggtgtcctcgtccaatcaggtagccatctctgaaatatctggctccgttgcaactccgaacgacctgctggcaacgtaaaattctccggggtaaaacttaaatgtggagtaatggaaccagaaacgtctcttcccttctctctccttccaccgcccgttaccgtccctaggaaattttactctgctggagagcttcttctacggcccccttgcagcaatgctcttcccagcattacgttgcgggtaaaacggaggtcgtgtacccgacctagcagcccagggatggaaaagtcccggccgtcgctggcaataatagcgggcggacgcatgtcatgagattattggaaaccaccagaatcgaatataaaaggcgaacacctttcccaattttggtttctcctgacccaaagactttaaatttaatttatttgtccctatttcaatcaattgaacaactatcaggcgcgccgaaacgatgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaaggtatcgctcatcgcgaaagtgaaacgtgatttcatgcgtcattttgaacattttgtaaatcttatttaataatgtgtgcggcaattcacatttaatttatgaatgttttcttaacatatcgcggcaactcaagaaacggcaggttcggatcttagctactagagattaaggaggtaaaaaaaatgagtgtgatcgctaaacaaatgacctacaaggtttatatgtcaggcacggtcaatggacactactttgaggtcgaaggtgatggaaaaggtaagccctacgagggggagcagacggtaaagctcactgtcaccaagggcggacctctgccatttgcttgggatattttatcaccacagtgtcagtacggaagcataccattcaccaagtaccctgaagatatccctgactatgtaaagcagtcattcccggagggctatacatgggagaggatcatgaactttgaagatggtgcagtgtgtactgtcagcaatgattccagcatccaaggcaactgtttcatctaccatgtcaagttctctggtttgaactttcctcccaatggacctgtcatgcagaagaaaacacagggctgggaacccaacactgagcgtctctttgcacgagatggaatgctgctaggaaacaactttatggctctgaagttagaaggaggcggtcactatttgtgtgaatttaaaactacttacaaggcaaagaagcctgtgaagatgccagggtatcactatgttgaccgcaaactggatgtaaccaatcacaacaaggattacacttcggttgagcagtgtgaaatttccattgcacgcaaacctgtggtcgcctaaggatctctccaaagcccgccgaaaggcgggcttttctgtgcgatgttgctgacagaggtgactacaaagatgacgacgataaagattacaaagacgatgacgataaggactataaagatgatgacgacaaataataacctgcaggagacatgactgttcctcagttcaagttgggcacttacgagaagaccggtcttgctagattctaatcaagaggatgtcagaatgccatttgcctgagagatgcaggcttcatttttgattacttttttatttgtaacctatatagtataggattttttttgtcattttgtttcttctcgtacgagcttgctcctgatcagcctatctcgcagctgatgaatatcttgtggtaggggtttgggaaaatcattcgagtttgatgtttttcttggtatttcccactcctcttcagagtacagaagattaagtgagaggatccttcagtaatgtcttgtttcttttgttgcagtggtgagccattttgacttcgtgaaagtttctttagaatagttgtttccagaggccaaacattccacccgtagtaaagtgcaagcgtaggaagaccaagactggcataaatcaggtataagtgtcgagcactggcaggtgatcttctgaaagtttctactagcagataagatccagtagtcatgcatatggcaacaatgtaccgtgtggatctaagaacgcgtcctactaaccttcgcattcgttggtccagtttgttgttatcgatcaacgtgacaaggttgtcgattccgcgtaagcatgcatacccaaggacgcctgttgcaattccaagtgagccagttccaacaatctttgtaatattagagcacttcattgtgttgcgcttgaaagtaaaatgcgaacaaattaagagataatctcgaaaccgcgacttcaaacgccaatatgatgtgcggcacacaataagcgttcatatccgctgggtgactttctcgctttaaaaaattatccgaaaaaatttttgacggctagctcagtcctaggtacgctagcattaaagaggagaaaatgaaaaagccagagctgacagccacctctgtagaaaagtttttgattgagaaattcgactcagttagcgatctgatgcagttgtcggaaggtgaggaatcccgtgcattttccttcgatgttggtggacgtggttatgtccttcgtgttaattcctgcgccgacggtttctacaaagacagatacgtgtacaggcacttcgcttccgctgctttgccaattcctgaggtccttgatattggagaattttccgagtctttgacatattgtatttctaggcgagcacaaggtgttactctacaagatttgcctgaaacagaattgcccgcagtactacagccagtggccgaagctatggacgcaatagcagccgctgacttgagtcagacgagtggttttggtccatttggaccccaaggtatcggtcaatacactacttggagagacttcatctgtgcaattgctgatccgcatgtgtatcattggcaaacggttatggatgacactgtatctgcatccgttgctcaggctttggatgagctgatgctttgggccgaagattgtcctgaagtcagacacctggtacacgctgatttcggctcaaataatgtgttgaccgacaacggtaggatcacagcagtgatcgactggtcagaggcaatgtttggagattcacaatacgaggtggctaacatctttttctggcgtccttggctcgcatgcatggaacaacaaactcgttatttcgagagaaggcatccagagttagctggttctcctagacttagagcctacatgctgagaattggattagatcagttgtatcaaagcttagttgatggcaattttgatgacgctgcttgggctcaaggaagatgtgacgctatcgtcagaagtggtgcaggcactgtcggtagaacacaaatagcaagacgtagcgctgctgtttggactgacggatgtgttgaggttttagccgacagtggtaacaggcgtccatccacaagaccaagagctaaggaataacacgtccgacggcggcccacgggtcccaggcctcggagatccgtcccccttttcctttgtcgatatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcaagctgcggccgcggtgtcatcaaggctggtatggtcgtcactttcgccccagctggtgtcactaccgaagtcaagtcggtcgagatgcaccacgagcaattggagcaaggtgtcccaggtgacaacgttggattcaacgtcaagaacgtttccgtcaaggaaatcagaagaggtaacgtctgtggtgactccaagaacgacccaccaaaggccgctgaatctttcaacgcccaggtcattatcttgaaccacccaggtcaaatctctgctggttacgctccagttttggactgtcacaccgctcacattgcttgtaagttcgacgagttgattgagaagattgacagaagaaccggtaagaagactgaggagaaccctaagttcatcaagtccggtgacgccgctatcgtcaagttggtcccatctaagccaatgtgtgttgaggccttcactgactacccacctttaggaagattcgctgtcagagacatgagacaaactgttgctgtcggtgttatcaagtccgttgtcaagactgacaaggctggtaaggtcaccaaggctgctcaaaaggccgctaagaaatagattgcttgaagctttaatttattttattaacataataataatacaagcatgatagagaccttaattaagcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaagacgtcccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggtgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataactgtcagaccaagtttactcatatatactttagattgatttaaaacttcatttttaatttaaaaggatctaggtgaagatcctt

SEQ ID NO: 2701 - DNA, 7096 bp, Artificial Sequence
  Description of Artificial Sequence: Synthetic polynucleotide
gcgatcgcggtctcactatccagaaaacggaacagattatggaattagtcaaaccaattgtcgacaatgttcgtcaaaatggtgacaaagcccttttagaactaactgccaagtttgatggagtcgctttgaagacacctgtgttagaagctcctttcccagaggaacttatgcaattgccagataacgttaagagagccattgatctctctatagataacgtcaggaaattccatgaagctcaactaacggagacgttgcaagttgagacttgccctggtgtagtctgctctcgttttgcaagacctattgagaaagttggcctctatattcctggtggaaccgcaattctgccttccacttccctgatgctgggtgttcctgccaaagttgctggttgcaaagaaattgtttttgcatctccacctaagaaggatggtacccttaccccagaagtcatctacgttgcccacaaggttggtgctaagtgtatcgtgctagcaggaggcgcccaggcagtagctgctatggcttacggaacagaaactgttcctaagtgtgacaaaatatttggtccaggaaaccagttcgttactgctgccaagatgatggttcaaaatgacacatcagccctgtgtagtattgacatgcctgctgggccttctgaagttctagttattgctgataaatacgctgatccagatttcgttgcctcagaccttctgtctcaagctgaacatggtattgattcccaggtgattctgttggctgtcgatatgacagacaaggagcttgccagaattgaagatgctgttcacaaccaagctgtgcagttgccaagggttgaaattgtacgcaagtgtattgcacactctacaaccctatcggttgcaacctacgagcaggctttggaaatgtccaatcagtacgctcctgaacacttgatcctgcaaatcgagaatgcttcttcttatgttgatcaagtacaacacgctggatctgtgtttgttggtgcctactctccagagagttgtggagattactcctccggtaccaaccacactttgccaacgtacggatatgcccgtcaatacagcggagttaacactgcaaccttccagaagttcatcacttcacaagacgtaactcctgagggactgaaacatattggccaagcagtgatggatctggctgctgttgaaggtctagatgctcaccgcaatgctgttaaggttcgtatggagaaactgggacttatttaattatttagagattttaacttacatttagattcgatagatctaaccggcatctaacatccagtgtttctaatctagtgaatcgagatcaagtctcactctgaacataataaataaggtctaaccccatggaattacatgtccccttgggttctgagattgtcttacccggtggggaaagagccatactcaagttcgtaggaaatgtggagtcaaagtctgggatttttgctggtgttgaactgattggtcaaatgagtggaaaaggaaaggcctcgatggcccagatctagggagggcatcattgaggtttccacaaaaggaagaaacatggatccagagacatcaacagagaggaaagcgggtagtgaagccgaagccacaacacagcccgatttggaagggagttcacaatcaaggtgagtccagccattttttttcttttttttttttttattcaggtgaacccacctaactatttttaactgggatccagtgagctcgctgggtgaaagccaaccatcttttgtttcggggaaccgtgctcgccccgtaaagttaatttttttttcccgcgcagctttaatctttcggcagagaaggcgttttcatcgtagcgtgggaacagaataatcagttcatgtgctatacaggcacatggcagcagtcactattttgctttttaaccttaaagtcgttcatcaatcattaactgaccaatcagattttttgcatttgccacttatctaaaaatacttttgtatctcgcagatacgttcagtggtttccaggacaacacccaaaaaaaggtatcaatgccactaggcagtcggttttatttttggtcacccacgcaaagaagcacccacctcttttaggttttaagttgtgggaacagtaacaccgcctagagcttcaggaaaaaccagtacctgtgaccgcaattcaccatgatgcagaatgttaatttaaacgagtgccaaatcaagatttcaacagacaaatcaatcgatccatagttacccattccagccttttcgtcgtcgagcctgcttcattcctgcctcaggtgcataactttgcatgaaaagtccagattagggcagattttgagtttaaaataggaaatataaacaaatataccgcgaaaaaggtttgtttatagcttttcgcctggtgccgtacggtataaatacatactctcctcccccccctggttctctttttcttttgttacttacattttaccgttccgtcactcgcttcactcaacaacaaaaggcgcgccgaaacgatgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaaggtatcgctcatcgcgaaagtgaaacgtgatttcatgcgtcattttgaacattttgtaaatcttatttaataatgtgtgcggcaattcacatttaatttatgaatgttttcttaacatatcgcggcaactcaagaaacggcaggttcggatcttagctactagagattaaggaggtaaaaaaaatgagtgtgatcgctaaacaaatgacctacaaggtttatatgtcaggcacggtcaatggacactactttgaggtcgaaggtgatggaaaaggtaagccctacgagggggagcagacggtaaagctcactgtcaccaagggcggacctctgccatttgcttgggatattttatcaccacagtgtcagtacggaagcataccattcaccaagtaccctgaagatatccctgactatgtaaagcagtcattcccggagggctatacatgggagaggatcatgaactttgaagatggtgcagtgtgtactgtcagcaatgattccagcatccaaggcaactgtttcatctaccatgtcaagttctctggtttgaactttcctcccaatggacctgtcatgcagaagaaaacacagggctgggaacccaacactgagcgtctctttgcacgagatggaatgctgctaggaaacaactttatggctctgaagttagaaggaggcggtcactatttgtgtgaatttaaaactacttacaaggcaaagaagcctgtgaagatgccagggtatcactatgttgaccgcaaactggatgtaaccaatcacaacaaggattacacttcggttgagcagtgtgaaatttccattgcacgcaaacctgtggtcgcctaaggatctctccaaagcccgccgaaaggcgggcttttctgtgcgatgttgctgacagaggtgactacaaagatgacgacgataaagattacaaagacgatgacgataaggactataaagatgatgacgacaaataataacctgcaggagacatgactgttcctcagttcaagttgggcacttacgagaagaccggtcttgctagattctaatcaagaggatgtcagaatgccatttgcctgagagatgcaggcttcatttttgattacttttttatttgtaacctatatagtataggattttttttgtcattttgtttcttctcgtacgagcttgctcctgatcagcctatctcgcagctgatgaatatcttgtggtaggggtttgggaaaatcattcgagtttgatgtttttcttggtatttcccactcctcttcagagtacagaagattaagtgagaggatccctggaccacaggtatctgatgcggccgcgcaaagttggtagatgtgacttccactgttgcttctggtataatccccattattgatgctcggcaattgactactgaatacgaactttctgaagatgtcaaaaagttccctgtcagtgaaattttgttggcgtctttgactactgaccgccccgatggtctattcactactttggtggctgactcttctaattactcgttgggcctggtgtactcgtccaaaaagtctattccggaggctataaggacacaaactggagtctaccaatctcgtcgtcacggtttgtggtataaaggtgctacatctggagcaactcaaaagttgctgggtatcgaattggattgtgatggagactgcttgaaatttgtggttgaacaaacaggtgttggtttctgtcacttggaacgcacttcctgttttggccaatcaaagggtcttagagccatggaagccaccttgtgggatcgtaagagcaatgctccagaaggttcttataccaaacggttatttgacgacgaagttttgttgaacgctaaaattagggaggaagctgatgaacttgcagaagctaaatccaaggaagatatagcctgggaatgtgctgacttattttattttgcattagttagatgtgccaagtacggtgtgacgttggacgaggtggagagaaacctggatatgaagtccctaaaggtcactagaaggaaaggagatgccaagccaggatacaccaaggaacaacctaaagaagaatccaaacctaaagaagtcccttctgaaggtcgtattgaattgtgcaaaattgacgtttctaaggcctcctcacaagaaattgaagatgcccttcgtcgtcctatagagaccttaattaagcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaagacgtcccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggtgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataactgtcagaccaagtttactcatatatactttagattgatttaaaacttcatttttaatttaaaaggatctaggtgaagatcctt

SEQ ID NO: 2702 - DNA, 7929 bp, Artificial Sequence
  Description of Artificial Sequence: Synthetic polynucleotide
gcgatcgcggtctcagacacttcaaaaccgttttggatcattcctctcttctcggattcagagtagtctaacttgaaagttgaagtgttactccaatacgagaaaggtctattggccagataaacaaccaggggaggaatgtgatccgtgccttcaacaatgtctgtcaaatttctagcatcacaaccaaagaaggttggcttactcgaaagattcaagtttaggaaagtggtggtatcaggtacataagggaacgttgttccatttgcttgagaagaaaactgtctcatgtaggtgttgactaatgatgaaccgtttggccaagagaggtcagtgtctgcactgttgtcaaacgcaaagatgatatcaacgtcacgctccttttgaagtagaggctgcagagggacgttttggttatcctctccaccatcaaccaagtaaagggtgtcattttccgcaatggcacctactcctgcatacgtacttttgtagaaagggttgggggaatagatagcaatgtcgtcttcgtcttcgctaagtccagtcagaaaatgctcaatgatttggtaaattgctcctgaaagatcactcgtattcagttgcagaataaactgattaaacaacgaggatgaagttcccagcacgaaaccagtgttgtcaaatccagcaatgcaaccacgctcatcatctgcgttatttggaacaccattggtaacgttagtaccaagatatgtcaaatcagtaaacccgtacactgaaggcctcgatggcccagatctagggagggcatcattgaggtttccacaaaaggaagaaacatggatccagagacatcaacagagaggaaagcgggtagtgaagccgaagccacaacacagcccgatttggaagggagttcacaatcaaggtgagtccagccattttttttcttttttttttttttattcaggtgaacccacctaactatttttaactgggatccagtgagctcgctgggtgaaagccaaccatcttttgtttcggggaaccgtgctcgccccgtaaagttaatttttttttcccgcgcagctttaatctttcggcagagaaggcgttttcatcgtagcgtgggaacagaataatcagttcatgtgctatacaggcacatggcagcagtcactattttgctttttaaccttaaagtcgttcatcaatcattaactgaccaatcagattttttgcatttgccacttatctaaaaatacttttgtatctcgcagatacgttcagtggtttccaggacaacacccaaaaaaaggtatcaatgccactaggcagtcggttttatttttggtcacccacgcaaagaagcacccacctcttttaggttttaagttgtgggaacagtaacaccgcctagagcttcaggaaaaaccagtacctgtgaccgcaattcaccatgatgcagaatgttaatttaaacgagtgccaaatcaagatttcaacagacaaatcaatcgatccatagttacccattccagccttttcgtcgtcgagcctgcttcattcctgcctcaggtgcataactttgcatgaaaagtccagattagggcagattttgagtttaaaataggaaatataaacaaatataccgcgaaaaaggtttgtttatagcttttcgcctggtgccgtacggtataaatacatactctcctcccccccctggttctctttttcttttgttacttacattttaccgttccgtcactcgcttcactcaacaacaaaaggcgcgccgaaacgatgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaaggtatcgctcatcgcgaaagtgaaacgtgatttcatgcgtcattttgaacattttgtaaatcttatttaataatgtgtgcggcaattcacatttaatttatgaatgttttcttaacatatcgcggcaactcaagaaacggcaggttcggatcttagctactagagattaaggaggtaaaaaaaatgagtgtgatcgctaaacaaatgacctacaaggtttatatgtcaggcacggtcaatggacactactttgaggtcgaaggtgatggaaaaggtaagccctacgagggggagcagacggtaaagctcactgtcaccaagggcggacctctgccatttgcttgggatattttatcaccacagtgtcagtacggaagcataccattcaccaagtaccctgaagatatccctgactatgtaaagcagtcattcccggagggctatacatgggagaggatcatgaactttgaagatggtgcagtgtgtactgtcagcaatgattccagcatccaaggcaactgtttcatctaccatgtcaagttctctggtttgaactttcctcccaatggacctgtcatgcagaagaaaacacagggctgggaacccaacactgagcgtctctttgcacgagatggaatgctgctaggaaacaactttatggctctgaagttagaaggaggcggtcactatttgtgtgaatttaaaactacttacaaggcaaagaagcctgtgaagatgccagggtatcactatgttgaccgcaaactggatgtaaccaatcacaacaaggattacacttcggttgagcagtgtgaaatttccattgcacgcaaacctgtggtcgcctaaggatctctccaaagcccgccgaaaggcgggcttttctgtgcgatgttgctgacagaggtgactacaaagatgacgacgataaagattacaaagacgatgacgataaggactataaagatgatgacgacaaataataacctgcaggagacatgactgttcctcagttcaagttgggcacttacgagaagaccggtcttgctagattctaatcaagaggatgtcagaatgccatttgcctgagagatgcaggcttcatttttgattacttttttatttgtaacctatatagtataggattttttttgtcattttgtttcttctcgtacgagcttgctcctgatcagcctatctcgcagctgatgaatatcttgtggtaggggtttgggaaaatcattcgagtttgatgtttttcttggtatttcccactcctcttcagagtacagaagattaagtgagaggatccttcagtaatgtcttgtttcttttgttgcagtggtgagccattttgacttcgtgaaagtttctttagaatagttgtttccagaggccaaacattccacccgtagtaaagtgcaagcgtaggaagaccaagactggcataaatcaggtataagtgtcgagcactggcaggtgatcttctgaaagtttctactagcagataagatccagtagtcatgcatatggcaacaatgtaccgtgtggatctaagaacgcgtcctactaaccttcgcattcgttggtccagtttgttgttatcgatcaacgtgacaaggttgtcgattccgcgtaagcatgcatacccaaggacgcctgttgcaattccaagtgagccagttccaacaatctttgtaatattagagcacttcattgtgttgcgcttgaaagtaaaatgcgaacaaattaagagataatctcgaaaccgcgacttcaaacgccaatatgatgtgcggcacacaataagcgttcatatccgctgggtgactttctcgctttaaaaaattatccgaaaaaatttttgacggctagctcagtcctaggtacgctagcattaaagaggagaaaatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatcccagggaaaacagcattccaggtattagaagaatatcctgattcaggtgaaaatattgttgatgcgctggcagtgttcctgcgccggttgcattcgattcctgtttgtaattgtccttttaacagtgatcgcgtatttcgtcttgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaacacgtccgacggcggcccacgggtcccaggcctcggagatccgtcccccttttcctttgtcgatatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcaagctgcggccgcacatggcactgtctgggaacctgttccattggtccaagagagggttccaagatcgtcaaatggggtggtgttttggatcacagatctaacgtttacggagtcaagggcctgaaggttggtgacttgtccgtctgtccagacaatgttggttgtaacacctacaccaccgctcttttgatcggtgaaaagactgccaccttggttggtgaagacttaggatacacaggtgaggccttagacatgactgtacctcagttcaagttgggcacttacgagaagactggtcttgctagattctagtttatgttgtatctatgaatatttttttacatggtggatttgttccaatctagttgttagttatttgtcgttatagtcactaatacagttaccatcggaatcttttcatttctttttatacgtacgtatatgtactagatgaagaatgcgacaaggccgaccaacagcaatggtgcttggtaccaaagtttggaaggtgctaccgaattggccgatgatattgaagtggagttgtcattctcctcattggttgctccagtagtggtaaaattaacggggatatcttcggtggaagtgtcaatatcaccgttccaacaataattctcaaaacatcttctacattgctctgtttgtgttgcattggatctctcctgctgtctacgaatgattgcacatccaacacaagtacgccattcttcatcaatagtcatgttcaaacgagacgacaagagaccttaattaagcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaagacgtcccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggtgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataactgtcagaccaagtttactcatatatactttagattgatttaaaacttcatttttaatttaaaaggatctaggtgaagatcctt

SEQ ID NO: 2703 - DNA, 7620 bp, Artificial Sequence
  Description of Artificial Sequence: Synthetic polynucleotide
gcgatcgcggtctcacagatgacagagttgtcaagaacttgaccactttgttgttcgacacagctttgttgacttccggtttcactttggatgagccaacttctttcgctgccagaatcaacggtttgatctccattggtttgaacatcgatgaggaggaagagaaagagccagaacaggctactgaagctccaagtgaagaagctgttgctgagtctgccatggaggaggttgactagttgaatttaggtatatatagtgactgtgatatttagctaatgaaatctaattggatatttagaatgcctcatctcgtagcctatcaattactattaggccatctcttatgggcccttctttgaaattgcattcaaggggggatgggactattttgaatttgaagtttggactctgtgagctgtttggccaattgaagtcatccacttgtacacagggattcaccagtagtttagaacaattctctatcgttattctcttgtcgtctttggcaatacaagcgtcgatgactgagttggtgactttatgaagtctaagttgatatgagtttgaaattatgaaacagttttttacactggacatgtagatagggcccttgatgtttaggaagaggatacagtttgagatgttggagatgtgtgtggagggagcgaccacttttaaaaccacatgatccagacgttgctcagttatcgaagtttcggaaacaaggcctcgatggcccagatctagggagggcatcattgaggtttccacaaaaggaagaaacatggatccagagacatcaacagagaggaaagcgggtagtgaagccgaagccacaacacagcccgatttggaagggagttcacaatcaaggtgagtccagccattttttttcttttttttttttttattcaggtgaacccacctaactatttttaactgggatccagtgagctcgctgggtgaaagccaaccatcttttgtttcggggaaccgtgctcgccccgtaaagttaatttttttttcccgcgcagctttaatctttcggcagagaaggcgttttcatcgtagcgtgggaacagaataatcagttcatgtgctatacaggcacatggcagcagtcactattttgctttttaaccttaaagtcgttcatcaatcattaactgaccaatcagattttttgcatttgccacttatctaaaaatacttttgtatctcgcagatacgttcagtggtttccaggacaacacccaaaaaaaggtatcaatgccactaggcagtcggttttatttttggtcacccacgcaaagaagcacccacctcttttaggttttaagttgtgggaacagtaacaccgcctagagcttcaggaaaaaccagtacctgtgaccgcaattcaccatgatgcagaatgttaatttaaacgagtgccaaatcaagatttcaacagacaaatcaatcgatccatagttacccattccagccttttcgtcgtcgagcctgcttcattcctgcctcaggtgcataactttgcatgaaaagtccagattagggcagattttgagtttaaaataggaaatataaacaaatataccgcgaaaaaggtttgtttatagcttttcgcctggtgccgtacggtataaatacatactctcctcccccccctggttctctttttcttttgttacttacattttaccgttccgtcactcgcttcactcaacaacaaaaggcgcgccgaaacgatgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaaggtatcgctcatcgcgaaagtgaaacgtgatttcatgcgtcattttgaacattttgtaaatcttatttaataatgtgtgcggcaattcacatttaatttatgaatgttttcttaacatatcgcggcaactcaagaaacggcaggttcggatcttagctactagagattaaggaggtaaaaaaaatgagtgtgatcgctaaacaaatgacctacaaggtttatatgtcaggcacggtcaatggacactactttgaggtcgaaggtgatggaaaaggtaagccctacgagggggagcagacggtaaagctcactgtcaccaagggcggacctctgccatttgcttgggatattttatcaccacagtgtcagtacggaagcataccattcaccaagtaccctgaagatatccctgactatgtaaagcagtcattcccggagggctatacatgggagaggatcatgaactttgaagatggtgcagtgtgtactgtcagcaatgattccagcatccaaggcaactgtttcatctaccatgtcaagttctctggtttgaactttcctcccaatggacctgtcatgcagaagaaaacacagggctgggaacccaacactgagcgtctctttgcacgagatggaatgctgctaggaaacaactttatggctctgaagttagaaggaggcggtcactatttgtgtgaatttaaaactacttacaaggcaaagaagcctgtgaagatgccagggtatcactatgttgaccgcaaactggatgtaaccaatcacaacaaggattacacttcggttgagcagtgtgaaatttccattgcacgcaaacctgtggtcgcctaaggatctctccaaagcccgccgaaaggcgggcttttctgtgcgatgttgctgacagaggtgactacaaagatgacgacgataaagattacaaagacgatgacgataaggactataaagatgatgacgacaaataataacctgcaggagacatgactgttcctcagttcaagttgggcacttacgagaagaccggtcttgctagattctaatcaagaggatgtcagaatgccatttgcctgagagatgcaggcttcatttttgattacttttttatttgtaacctatatagtataggattttttttgtcattttgtttcttctcgtacgagcttgctcctgatcagcctatctcgcagctgatgaatatcttgtggtaggggtttgggaaaatcattcgagtttgatgtttttcttggtatttcccactcctcttcagagtacagaagattaagtgagaggatccttcagtaatgtcttgtttcttttgttgcagtggtgagccattttgacttcgtgaaagtttctttagaatagttgtttccagaggccaaacattccacccgtagtaaagtgcaagcgtaggaagaccaagactggcataaatcaggtataagtgtcgagcactggcaggtgatcttctgaaagtttctactagcagataagatccagtagtcatgcatatggcaacaatgtaccgtgtggatctaagaacgcgtcctactaaccttcgcattcgttggtccagtttgttgttatcgatcaacgtgacaaggttgtcgattccgcgtaagcatgcatacccaaggacgcctgttgcaattccaagtgagccagttccaacaatctttgtaatattagagcacttcattgtgttgcgcttgaaagtaaaatgcgaacaaattaagagataatctcgaaaccgcgacttcaaacgccaatatgatgtgcggcacacaataagcgttcatatccgctgggtgactttctcgctttaaaaaattatccgaaaaaatttttgacggctagctcagtcctaggtacgctagcattaaagaggagaaaatgactactcttgatgacacagcctacagatataggacatcagttccgggtgacgcagaggctatcgaagccttggacggttcattcactactgatacggtgtttagagtcaccgctacaggtgatggcttcaccttgagagaggttcctgtagacccacccttaacgaaagttttccctgatgacgaatcggatgacgagtctgatgctggtgaggacggtgaccctgattccagaacatttgtcgcatacggagatgatggtgacctggctggctttgttgtggtgtcctacagcggatggaatcgtagactcacagttgaggacatcgaagttgcacctgaacatcgtggtcacggtgttggtcgtgcactgatgggactggcaacagagtttgctagagaaagaggagccggacatttgtggttagaagtgaccaatgtcaacgctcctgctattcacgcatataggcgaatgggtttcactttgtgcggtcttgatactgctttgtatgacggaactgcttctgatggtgaacaagctctttacatgagtatgccatgtccatagcacgtccgacggcggcccacgggtcccaggcctcggagatccgtcccccttttcctttgtcgatatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcaagctgcggccgcaagaagttgattgagactttcaacgagattgctgaagacaaggaacaattcgagaagttttacagtgctttctccaagaacttgaagttgggtgtccatgaagacagccaaaacagatccgcattggccaagttgctgagatttaactccaccaagtctactgaggagctaacctcattctctgactacgtcaccagaatgccagagcaccagaagaacatctacttcattaccggtgagtctgtcaaggctcttgagaaatctccattcttggatgctttgaaggagaagaactttgaggtcctattgctgaccgatcctattgatgagtacgctatgactcaattgaaagagattgaggacaagaaattggttgacatcactaaagactttgagctggaagagtctgaggaggagaagaaggctagagaggaagaggttaaagatttcgagcctttgactaaagccctgaaagagattttgggtgacaaggttgagaaggttgtagtttcctacaagctggttgactctcctgctgctattagaacttcccaattcggctggtctgctaacatggaaagaattatgaaggctcaagctctgagagacaccaacaccatgtcctcgtacatggcttcaaagaagatcttcgagatctctccaaagtcgccaatcattaaggctttgagaaagaaggttgaggctaccggtacagaagagaccttaattaagcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaagacgtcccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggtgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataactgtcagaccaagtttactcatatatactttagattgatttaaaacttcatttttaatttaaaaggatctaggtgaagatcctt

SEQ ID NO: 2704 - DNA, 7904 bp, Artificial Sequence
  Description of Artificial Sequence: Synthetic polynucleotide
gcgatcgcggtctcatgatatatttgtattttgttcgttaacattgatgttttcttcatttactgttattgtttgtaactttgatcgatttatcttttctactttactgtaatatggctggcgggtgagccttgaactccctgtattactttaccttgctattacttaatctattgactagcagcgacctcttcaaccgaagggcaagtacacagcaagttcatgtctccgtaagtgtcatcaaccctggaaacagtgggccatgtcttttgctccttcaaaaatggcaatgggtaggctgcctcctctcttgtgtatcctctctgggaccactcagcgtcacttgtgctaataatatcttttaggttgtgtggggagttgtgcaagattgcaccatctgtttctccgttttctactttacggatttcttctctaatagagatcatagagtcaatgaatctgtctaattcttctttgtattcggattcagttggttctaccatcaatgtgcccggaatagggaacgacatggtaggagcatggaatccataatcttgcagacgcttggccacatcaatggcctcaattccgaatttcttgaatggtctaagatcaataatgaactcatggccacagtacttgtggcctcgatggcccagatctagggagggcatcattgaggtttccacaaaaggaagaaacatggatccagagacatcaacagagaggaaagcgggtagtgaagccgaagccacaacacagcccgatttggaagggagttcacaatcaaggtgagtccagccattttttttcttttttttttttttattcaggtgaacccacctaactatttttaactgggatccagtgagctcgctgggtgaaagccaaccatcttttgtttcggggaaccgtgctcgccccgtaaagttaatttttttttcccgcgcagctttaatctttcggcagagaaggcgttttcatcgtagcgtgggaacagaataatcagttcatgtgctatacaggcacatggcagcagtcactattttgctttttaaccttaaagtcgttcatcaatcattaactgaccaatcagattttttgcatttgccacttatctaaaaatacttttgtatctcgcagatacgttcagtggtttccaggacaacacccaaaaaaaggtatcaatgccactaggcagtcggttttatttttggtcacccacgcaaagaagcacccacctcttttaggttttaagttgtgggaacagtaacaccgcctagagcttcaggaaaaaccagtacctgtgaccgcaattcaccatgatgcagaatgttaatttaaacgagtgccaaatcaagatttcaacagacaaatcaatcgatccatagttacccattccagccttttcgtcgtcgagcctgcttcattcctgcctcaggtgcataactttgcatgaaaagtccagattagggcagattttgagtttaaaataggaaatataaacaaatataccgcgaaaaaggtttgtttatagcttttcgcctggtgccgtacggtataaatacatactctcctcccccccctggttctctttttcttttgttacttacattttaccgttccgtcactcgcttcactcaacaacaaaaggcgcgccgaaacgatgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaaggtatcgctcatcgcgaaagtgaaacgtgatttcatgcgtcattttgaacattttgtaaatcttatttaataatgtgtgcggcaattcacatttaatttatgaatgttttcttaacatatcgcggcaactcaagaaacggcaggttcggatcttagctactagagattaaggaggtaaaaaaaatgagtgtgatcgctaaacaaatgacctacaaggtttatatgtcaggcacggtcaatggacactactttgaggtcgaaggtgatggaaaaggtaagccctacgagggggagcagacggtaaagctcactgtcaccaagggcggacctctgccatttgcttgggatattttatcaccacagtgtcagtacggaagcataccattcaccaagtaccctgaagatatccctgactatgtaaagcagtcattcccggagggctatacatgggagaggatcatgaactttgaagatggtgcagtgtgtactgtcagcaatgattccagcatccaaggcaactgtttcatctaccatgtcaagttctctggtttgaactttcctcccaatggacctgtcatgcagaagaaaacacagggctgggaacccaacactgagcgtctctttgcacgagatggaatgctgctaggaaacaactttatggctctgaagttagaaggaggcggtcactatttgtgtgaatttaaaactacttacaaggcaaagaagcctgtgaagatgccagggtatcactatgttgaccgcaaactggatgtaaccaatcacaacaaggattacacttcggttgagcagtgtgaaatttccattgcacgcaaacctgtggtcgcctaaggatctctccaaagcccgccgaaaggcgggcttttctgtgcgatgttgctgacagaggtgactacaaagatgacgacgataaagattacaaagacgatgacgataaggactataaagatgatgacgacaaataataacctgcaggagacatgactgttcctcagttcaagttgggcacttacgagaagaccggtcttgctagattctaatcaagaggatgtcagaatgccatttgcctgagagatgcaggcttcatttttgattacttttttatttgtaacctatatagtataggattttttttgtcattttgtttcttctcgtacgagcttgctcctgatcagcctatctcgcagctgatgaatatcttgtggtaggggtttgggaaaatcattcgagtttgatgtttttcttggtatttcccactcctcttcagagtacagaagattaagtgagaggatccttcagtaatgtcttgtttcttttgttgcagtggtgagccattttgacttcgtgaaagtttctttagaatagttgtttccagaggccaaacattccacccgtagtaaagtgcaagcgtaggaagaccaagactggcataaatcaggtataagtgtcgagcactggcaggtgatcttctgaaagtttctactagcagataagatccagtagtcatgcatatggcaacaatgtaccgtgtggatctaagaacgcgtcctactaaccttcgcattcgttggtccagtttgttgttatcgatcaacgtgacaaggttgtcgattccgcgtaagcatgcatacccaaggacgcctgttgcaattccaagtgagccagttccaacaatctttgtaatattagagcacttcattgtgttgcgcttgaaagtaaaatgcgaacaaattaagagataatctcgaaaccgcgacttcaaacgccaatatgatgtgcggcacacaataagcgttcatatccgctgggtgactttctcgctttaaaaaattatccgaaaaaatttttgacggctagctcagtcctaggtacgctagcattaaagaggagaaaatgaaaaagccagagctgacagccacctctgtagaaaagtttttgattgagaaattcgactcagttagcgatctgatgcagttgtcggaaggtgaggaatcccgtgcattttccttcgatgttggtggacgtggttatgtccttcgtgttaattcctgcgccgacggtttctacaaagacagatacgtgtacaggcacttcgcttccgctgctttgccaattcctgaggtccttgatattggagaattttccgagtctttgacatattgtatttctaggcgagcacaaggtgttactctacaagatttgcctgaaacagaattgcccgcagtactacagccagtggccgaagctatggacgcaatagcagccgctgacttgagtcagacgagtggttttggtccatttggaccccaaggtatcggtcaatacactacttggagagacttcatctgtgcaattgctgatccgcatgtgtatcattggcaaacggttatggatgacactgtatctgcatccgttgctcaggctttggatgagctgatgctttgggccgaagattgtcctgaagtcagacacctggtacacgctgatttcggctcaaataatgtgttgaccgacaacggtaggatcacagcagtgatcgactggtcagaggcaatgtttggagattcacaatacgaggtggctaacatctttttctggcgtccttggctcgcatgcatggaacaacaaactcgttatttcgagagaaggcatccagagttagctggttctcctagacttagagcctacatgctgagaattggattagatcagttgtatcaaagcttagttgatggcaattttgatgacgctgcttgggctcaaggaagatgtgacgctatcgtcagaagtggtgcaggcactgtcggtagaacacaaatagcaagacgtagcgctgctgtttggactgacggatgtgttgaggttttagccgacagtggtaacaggcgtccatccacaagaccaagagctaaggaataacacgtccgacggcggcccacgggtcccaggcctcggagatccgtcccccttttcctttgtcgatatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcaagctgcggccgcggtgtcatcaaggctggtatggtcgtcactttcgccccagctggtgtcactaccgaagtcaagtcggtcgagatgcaccacgagcaattggagcaaggtgtcccaggtgacaacgttggattcaacgtcaagaacgtttccgtcaaggaaatcagaagaggtaacgtctgtggtgactccaagaacgacccaccaaaggccgctgaatctttcaacgcccaggtcattatcttgaaccacccaggtcaaatctctgctggttacgctccagttttggactgtcacaccgctcacattgcttgtaagttcgacgagttgattgagaagattgacagaagaaccggtaagaagactgaggagaaccctaagttcatcaagtccggtgacgccgctatcgtcaagttggtcccatctaagccaatgtgtgttgaggccttcactgactacccacctttaggaagattcgctgtcagagacatgagacaaactgttgctgtcggtgttatcaagtccgttgtcaagactgacaaggctggtaaggtcaccaaggctgctcaaaaggccgctaagaaatagattgcttgaagctttaatttattttattaacataataataatacaagcatgatagagaccttaattaagcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaagacgtcccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggtgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataactgtcagaccaagtttactcatatatactttagattgatttaaaacttcatttttaatttaaaaggatctaggtgaagatcctt

SEQ ID NO: 2705 - DNA, 6316 bp, Artificial Sequence
  Description of Artificial Sequence: Synthetic polynucleotide
gcgatcgcggtctcacgttaggtcagtgatgacaatggaccaaattgttgcaaggtttttctttttctttcatcggcacatttcagcctcacatgcgactattatcgatcaatgaaatccatcaagattgaaatcttaaaattgcccctttcacttgacaggatccttttttgtagaaatgtcttggtgtcctcgtccaatcaggtagccatctctgaaatatctggctccgttgcaactccgaacgacctgctggcaacgtaaaattctccggggtaaaacttaaatgtggagtaatggaaccagaaacgtctattcccttctctctccttccaccgcccgttaccgtccctaggaaattttactctgctggagagcttcttctacggcccccttgcagcaatgctcttcccagcattacgttgcgggtaaaacggaggtcgtgtacccgacctagcagcccagggatggaaaagtcccggccgtcgctggcaataatagcgggcggacgcatgtcatgagattattggaaaccaccagaatcgaatataaaaggcgaacacctttcccaattttggtttctcctgacccaaagactttaaatttaatttatttgtccctatttcaatcaattgaacaactatcaggcgcgccgaaacgatgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtagagacggaaagtgaaacgtgatttcatgcgtcattttgaacattttgtaaatcttatttaataatgtgtgcggcaattcacatttaatttatgaatgttttcttaacatatcgcggcaactcaagaaacggcaggttcggatcttagctactagagattaaggaggtaaaaaaaatgagtgtgatcgctaaacaaatgacctacaaggtttatatgtcaggcacggtcaatggacactactttgaggtcgaaggtgatggaaaaggtaagccctacgagggggagcagacggtaaagctcactgtcaccaagggcggacctctgccatttgcttgggatattttatcaccacagtgtcagtacggaagcataccattcaccaagtaccctgaagatatccctgactatgtaaagcagtcattcccggagggctatacatgggagaggatcatgaactttgaagatggtgcagtgtgtactgtcagcaatgattccagcatccaaggcaactgtttcatctaccatgtcaagttctctggtttgaactttcctcccaatggacctgtcatgcagaagaaaacacagggctgggaacccaacactgagcgtctgtttgcacgagatggaatgctgctaggaaacaactttatggctctgaagttagaaggaggcggtcactatttgtgtgaatttaaaactacttacaaggcaaagaagcctgtgaagatgccagggtatcactatgttgaccgcaaactggatgtaaccaatcacaacaaggattacacttcggttgagcagtgtgaaatttccattgcacgcaaacctgtggtcgcctaaggatctctccaaagcccgccgaaaggcgggcttttctgtcgtctcaaggtgactacaaagatgacgacgataaagattacaaagacgatgacgataaggactataaagatgatgacgacaaataataacctgcaggagacatgactgttcctcagttcaagttgggcacttacgagaagaccggtcttgctagattctaatcaagaggatgtcagaatgccatttgcctgagagatgcaggcttcatttttgattacttttttatttgtaacctatatagtataggattttttttgtcattttgtttcttctcgtacgagcttgctcctgatcagcctatctcgcagctgatgaatatcttgtggtaggggtttgggaaaatcattcgagtttgatgtttttcttggtatttcccactcctcttcagagtacagaagattaagtgagaggatccttcagtaatgtcttgtttcttttgttgcagtggtgagccattttgacttcgtgaaagtttctttagaatagttgtttccagaggccaaacattccacccgtagtaaagtgcaagcgtaggaagaccaagactggcataaatcaggtataagtgtcgagcactggcaggtgatcttctgaaagtttctactagcagataagatccagtagtcatgcatatggcaacaatgtaccgtgtggatctaagaacgcgtcctactaaccttcgcattcgttggtccagtttgttgttatcgatcaacgtgacaaggttgtcgattccgcgtaagcatgcatacccaaggacgcctgttgcaattccaagtgagccagttccaacaatctttgtaatattagagcacttcattgtgttgcgcttgaaagtaaaatgcgaacaaattaagagataatctcgaaaccgcgacttcaaacgccaatatgatgtgcggcacacaataagcgttcatatccgctgggtgactttctcgctttaaaaaattatccgaaaaaatttttgacggctagctcagtcctaggtacgctagcattaaagaggagaaaatgactactcttgatgacacagcctacagatataggacatcagttccgggtgacgcagaggctatcgaagccttggacggttcattcactactgatacggtgtttagagtcaccgctacaggtgatggcttcaccttgagagaggttcctgtagacccacccttaacgaaagttttccctgatgacgaatcggatgacgagtctgatgctggtgaggacggtgaccctgattccagaacatttgtcgcatacggagatgatggtgacctggctggctttgttgtggtgtcctacagcggatggaatcgtagactcacagttgaggacatcgaagttgcacctgaacatcgtggtcacggtgttggtcgtgcactgatgggactggcaacagagtttgctagagaaagaggagccggacatttgtggttagaagtgaccaatgtcaacgctcctgctattcacgcatataggcgaatgggtttcactttgtgcggtcttgatactgctttgtatgacggaactgcttctgatggtgaacaagctctttacatgagtatgccatgtccatagcacgtccgacggcggcccacgggtcccaggcctcggagatccgtcccccttttcctttgtcgatatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcaagctgcggccgcactcaatcccgactgtcaatcattcatccttgcgtcttttgaacatctatgcttccacaagtcaattcttgatttagtatacacataaccaaatttggatcaagtttgaagtaaaactttaacttcagctccttacatttgcactaagatctctgctactctggtcccaagtgaaccaccttttggaccctattgaccggaccttaacttgccaaacctaaacgcttaatgcctcagacgttttaatgcctctcaacacctccaaggttgctttcttgagcatgcctactaggaactttaacgaactgtggggttgcagacagtttcaggcgtgtcccgaccaatatggcctactagactctctgaaaaatcacagttttccagtagttccgatcaaattaccatcgaaatggtcccataaacggacatttgacatccgttcctgaattatagtcttccaccgtggatcatggtgttcctttttttcccaaagaatatcagcatcccttaactacgttagagaccttaattaagcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaagacgtcccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggtgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataactgtcagaccaagtttactcatatatactttagattgatttaaaacttcatttttaatttaaaaggatctaggtgaagatcctt

SEQ ID NO: 2706 - DNA, 7083 bp, Artificial Sequence
  Description of Artificial Sequence: Synthetic polynucleotide
gcgatcgcggtctcacagatgacagagttgtcaagaacttgaccactttgttgttcgacacagctttgttgacttccggtttcactttggatgagccaacttctttcgctgccagaatcaacggtttgatctccattggtttgaacatcgatgaggaggaagagaaagagccagaacaggctactgaagctccaagtgaagaagctgttgctgagtctgccatggaggaggttgactagttgaatttaggtatatatagtgactgtgatatttagctaatgaaatctaattggatatttagaatgcctcatctcgtagcctatcaattactattaggccatctcttatgggcccttctttgaaattgcattcaaggggggatgggactattttgaatttgaagtttggactctgtgagctgtttggccaattgaagtcatccacttgtacacagggattcaccagtagtttagaacaattctctatcgttattctcttgtcgtctttggcaatacaagcgtcgatgactgagttggtgactttatgaagtctaagttgatatgagtttgaaattatgaaacagttttttacactggacatgtagatagggcccttgatgtttaggaagaggatacagtttgagatgttggagatgtgtgtggagggagcgaccacttttaaaaccacatgatccagacgttgctcagttatcgaagtttcggaaacaacctcagcttttttgtagaaatgtcttggtgtcctcgtccaatcaggtagccatctctgaaatatctggctccgttgcaactccgaacgacctgctggcaacgtaaaattctccggggtaaaacttaaatgtggagtaatggaaccagaaacgtctattcccttctctctccttccaccgcccgttaccgtccctaggaaattttactctgctggagagcttcttctacggcccccttgcagcaatgctcttcccagcattacgttgcgggtaaaacggaggtcgtgtacccgacctagcagcccagggatggaaaagtcccggccgtcgctggcaataatagcgggcggacgcatgtcatgagattattggaaaccaccagaatcgaatataaaaggcgaacacctttcccaattttggtttctcctgacccaaagactttaaatttaatttatttgtccctatttcaatcaattgaacaactatcaggcgcgccgaaacgatgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtagagacggaaagtgaaacgtgatttcatgcgtcattttgaacattttgtaaatcttatttaataatgtgtgcggcaattcacatttaatttatgaatgttttcttaacatatcgcggcaactcaagaaacggcaggttcggatcttagctactagagattaaggaggtaaaaaaaatgagtgtgatcgctaaacaaatgacctacaaggtttatatgtcaggcacggtcaatggacactactttgaggtcgaaggtgatggaaaaggtaagccctacgagggggagcagacggtaaagctcactgtcaccaagggcggacctctgccatttgcttgggatattttatcaccacagtgtcagtacggaagcataccattcaccaagtaccctgaagatatccctgactatgtaaagcagtcattcccggagggctatacatgggagaggatcatgaactttgaagatggtgcagtgtgtactgtcagcaatgattccagcatccaaggcaactgtttcatctaccatgtcaagttctctggtttgaactttcctcccaatggacctgtcatgcagaagaaaacacagggctgggaacccaacactgagcgtctgtttgcacgagatggaatgctgctaggaaacaactttatggctctgaagttagaaggaggcggtcactatttgtgtgaatttaaaactacttacaaggcaaagaagcctgtgaagatgccagggtatcactatgttgaccgcaaactggatgtaaccaatcacaacaaggattacacttcggttgagcagtgtgaaatttccattgcacgcaaacctgtggtcgcctaaggatctctccaaagcccgccgaaaggcgggcttttctgtcgtctcaaggtgactacaaagatgacgacgataaagattacaaagacgatgacgataaggactataaagatgatgacgacaaataataacctgcaggagacatgactgttcctcagttcaagttgggcacttacgagaagaccggtcttgctagattctaatcaagaggatgtcagaatgccatttgcctgagagatgcaggcttcatttttgattacttttttatttgtaacctatatagtataggattttttttgtcattttgtttcttctcgtacgagcttgctcctgatcagcctatctcgcagctgatgaatatcttgtggtaggggtttgggaaaatcattcgagtttgatgtttttcttggtatttcccactcctcttcagagtacagaagattaagtgagaggatccttcagtaatgtcttgtttcttttgttgcagtggtgagccattttgacttcgtgaaagtttctttagaatagttgtttccagaggccaaacattccacccgtagtaaagtgcaagcgtaggaagaccaagactggcataaatcaggtataagtgtcgagcactggcaggtgatcttctgaaagtttctactagcagataagatccagtagtcatgcatatggcaacaatgtaccgtgtggatctaagaacgcgtcctactaaccttcgcattcgttggtccagtttgttgttatcgatcaacgtgacaaggttgtcgattccgcgtaagcatgcatacccaaggacgcctgttgcaattccaagtgagccagttccaacaatctttgtaatattagagcacttcattgtgttgcgcttgaaagtaaaatgcgaacaaattaagagataatctcgaaaccgcgacttcaaacgccaatatgatgtgcggcacacaataagcgttcatatccgctgggtgactttctcgctttaaaaaattatccgaaaaaatttttgacggctagctcagtcctaggtacgctagcattaaagaggagaaaatgactactcttgatgacacagcctacagatataggacatcagttccgggtgacgcagaggctatcgaagccttggacggttcattcactactgatacggtgtttagagtcaccgctacaggtgatggcttcaccttgagagaggttcctgtagacccacccttaacgaaagttttccctgatgacgaatcggatgacgagtctgatgctggtgaggacggtgaccctgattccagaacatttgtcgcatacggagatgatggtgacctggctggctttgttgtggtgtcctacagcggatggaatcgtagactcacagttgaggacatcgaagttgcacctgaacatcgtggtcacggtgttggtcgtgcactgatgggactggcaacagagtttgctagagaaagaggagccggacatttgtggttagaagtgaccaatgtcaacgctcctgctattcacgcatataggcgaatgggtttcactttgtgcggtcttgatactgctttgtatgacggaactgcttctgatggtgaacaagctctttacatgagtatgccatgtccatagcacgtccgacggcggcccacgggtcccaggcctcggagatccgtcccccttttcctttgtcgatatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcaagctgcggccgcaagaagttgattgagactttcaacgagattgctgaagacaaggaacaattcgagaagttttacagtgctttctccaagaacttgaagttgggtgtccatgaagacagccaaaacagatccgcattggccaagttgctgagatttaactccaccaagtctactgaggagctaacctcattctctgactacgtcaccagaatgccagagcaccagaagaacatctacttcattaccggtgagtctgtcaaggctcttgagaaatctccattcttggatgctttgaaggagaagaactttgaggtcctattgctgaccgatcctattgatgagtacgctatgactcaattgaaagagattgaggacaagaaattggttgacatcactaaagactttgagctggaagagtctgaggaggagaagaaggctagagaggaagaggttaaagatttcgagcctttgactaaagccctgaaagagattttgggtgacaaggttgagaaggttgtagtttcctacaagctggttgactctcctgctgctattagaacttcccaattcggctggtctgctaacatggaaagaattatgaaggctcaagctctgagagacaccaacaccatgtcctcgtacatggcttcaaagaagatcttcgagatctctccaaagtcgccaatcattaaggctttgagaaagaaggttgaggctaccggtacagaagagaccttaattaagcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaagacgtcccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggtgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataactgtcagaccaagtttactcatatatactttagattgatttaaaacttcatttttaatttaaaaggatctaggtgaagatcctt

SEQ ID NO: 2707 - DNA, 6374 bp, Artificial Sequence
  Description of Artificial Sequence: Synthetic polynucleotide
gcgatcgcggtctcacgttaggtcagtgatgacaatggaccaaattgttgcaaggtttttctttttctttcatcggcacatttcagcctcacatgcgactattatcgatcaatgaaatccatcaagattgaaatcttaaaattgcccctttcacttgacaggatccttttttgtagaaatgtcttggtgtcctcgtccaatcaggtagccatctctgaaatatctggctccgttgcaactccgaacgacctgctggcaacgtaaaattctccggggtaaaacttaaatgtggagtaatggaaccagaaacgtctattcccttctctctccttccaccgcccgttaccgtccctaggaaattttactctgctggagagcttcttctacggcccccttgcagcaatgctcttcccagcattacgttgcgggtaaaacggaggtcgtgtacccgacctagcagcccagggatggaaaagtcccggccgtcgctggcaataatagcgggcggacgcatgtcatgagattattggaaaccaccagaatcgaatataaaaggcgaacacctttcccaattttggtttctcctgacccaaagactttaaatttaatttatttgtccctatttcaatcaattgaacaactatcaggcgcgccgaaacgatgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtagagacggaaagtgaaacgtgatttcatgcgtcattttgaacattttgtaaatcttatttaataatgtgtgcggcaattcacatttaatttatgaatgttttcttaacatatcgcggcaactcaagaaacggcaggttcggatcttagctactagaccttaggaggtaaacatatgtcgtctggtgccaaattgtttgaaaatgaaatcccgtatgtcactgaactcgagggcgacgtcaatggtatgaagtttaccattcatggtaaaggtaccggcgatgcgagcgttggtaccattaaagcgcagttcatctgcactacgggcgacctgccggtcccgtgggcaaccctggtgagcaccctgagctacggtgttcagtgtttcgccaagtacccgccgcacatcaaggatttctacaagagctgcatgccggaaggttatgttcaagagcgtaccatcaccttcgaaggcgacggcgtgtttaagacgcgtgctgaggttacctttgaaaacggttctgtctacaatcgtgtcaaactgactggccagggttttaagaaagacggtcacattctgcgtaagaacgttgcattccaatgcccgccaagcattctgtatattctgcctgacaccgttaacaatggcatccgcgttgagttcaaccaggcgtacgatattgaaggtgtgaccgaaaaactggttaccaaatgcagccaaatgaatcgtccgttggcgggctccgcggcagtgcatatcccgcgttatcatcacctgagcaaacacaccaaactgagcaaagaccgcgacgagcgccgtgatcacatgtgtctggtagaggtcgtgaaagcggttgatctggacacgtatcagtaaggatctctccaaagcccgccgaaaggcgggcttttctgtcgtctcaaggtgactacaaagatgacgacgataaagattacaaagacgatgacgataaggactataaagatgatgacgacaaataataacctgcaggagacatgactgttcctcagttcaagttgggcacttacgagaagaccggtcttgctagattctaatcaagaggatgtcagaatgccatttgcctgagagatgcaggcttcatttttgattacttttttatttgtaacctatatagtataggattttttttgtcattttgtttcttctcgtacgagcttgctcctgatcagcctatctcgcagctgatgaatatcttgtggtaggggtttgggaaaatcattcgagtttgatgtttttcttggtatttcccactcctcttcagagtacagaagattaagtgagaggatccttcagtaatgtcttgtttcttttgttgcagtggtgagccattttgacttcgtgaaagtttctttagaatagttgtttccagaggccaaacattccacccgtagtaaagtgcaagcgtaggaagaccaagactggcataaatcaggtataagtgtcgagcactggcaggtgatcttctgaaagtttctactagcagataagatccagtagtcatgcatatggcaacaatgtaccgtgtggatctaagaacgcgtcctactaaccttcgcattcgttggtccagtttgttgttatcgatcaacgtgacaaggttgtcgattccgcgtaagcatgcatacccaaggacgcctgttgcaattccaagtgagccagttccaacaatctttgtaatattagagcacttcattgtgttgcgcttgaaagtaaaatgcgaacaaattaagagataatctcgaaaccgcgacttcaaacgccaatatgatgtgcggcacacaataagcgttcatatccgctgggtgactttctcgctttaaaaaattatccgaaaaaatttttgacggctagctcagtcctaggtacgctagcattaaagaggagaaaatgactactcttgatgacacagcctacagatataggacatcagttccgggtgacgcagaggctatcgaagccttggacggttcattcactactgatacggtgtttagagtcaccgctacaggtgatggcttcaccttgagagaggttcctgtagacccacccttaacgaaagttttccctgatgacgaatcggatgacgagtctgatgctggtgaggacggtgaccctgattccagaacatttgtcgcatacggagatgatggtgacctggctggctttgttgtggtgtcctacagcggatggaatcgtagactcacagttgaggacatcgaagttgcacctgaacatcgtggtcacggtgttggtcgtgcactgatgggactggcaacagagtttgctagagaaagaggagccggacatttgtggttagaagtgaccaatgtcaacgctcctgctattcacgcatataggcgaatgggtttcactttgtgcggtcttgatactgctttgtatgacggaactgcttctgatggtgaacaagctctttacatgagtatgccatgtccatagcacgtccgacggcggcccacgggtcccaggcctcggagatccgtcccccttttcctttgtcgatatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcaagctgcggccgcactcaatcccgactgtcaatcattcatccttgcgtcttttgaacatctatgcttccacaagtcaattcttgatttagtatacacataaccaaatttggatcaagtttgaagtaaaactttaacttcagctccttacatttgcactaagatctctgctactctggtcccaagtgaaccaccttttggaccctattgaccggaccttaacttgccaaacctaaacgcttaatgcctcagacgttttaatgcctctcaacacctccaaggttgctttcttgagcatgcctactaggaactttaacgaactgtggggttgcagacagtttcaggcgtgtcccgaccaatatggcctactagactctctgaaaaatcacagttttccagtagttccgatcaaattaccatcgaaatggtcccataaacggacatttgacatccgttcctgaattatagtcttccaccgtggatcatggtgttcctttttttcccaaagaatatcagcatcccttaactacgttagagaccttaattaacgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaagacgtcccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggtgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataactgtcagaccaagtttactcatatatactttagattgatttaaaacttcatttttaatttaaaaggatctaggtgaagatcctt

SEQ ID NO: 2708 - DNA, 465 bp, Artificial Sequence
  Description of Artificial Sequence: Synthetic polynucleotide
ggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgcaggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaa

SEQ ID NO: 2709 - DNA, 480 bp, Artificial Sequence
  Description of Artificial Sequence: Synthetic polynucleotide
ggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgcaggtggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggacca

SEQ ID NO: 2710 - DNA, 945 bp, Artificial Sequence
  Description of Artificial Sequence: Synthetic polynucleotide
ggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgcaggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaaggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgcaggtggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggacca

SEQ ID NO: 2711 - DNA, 945 bp, Artificial Sequence
  Description of Artificial Sequence: Synthetic polynucleotide
ggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaaggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgcaggtggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggaccaggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgca

SEQ ID NO: 2712 - DNA, 945 bp, Artificial Sequence
  Description of Artificial Sequence: Synthetic polynucleotide
ggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgcaggtggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggaccaggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgcaggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaa

SEQ ID NO: 2713 - DNA, 2835 bp, Artificial Sequence
  Description of Artificial Sequence: Synthetic polynucleotide
ggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgcaggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaaggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgcaggtggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggaccaggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgcaggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaaggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgcaggtggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggaccaggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgcaggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaaggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgcaggtggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggacca

SEQ ID NO: 2714 - DNA, 2835 bp, Artificial Sequence
  Description of Artificial Sequence: Synthetic polynucleotide
ggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaaggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgcaggtggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggaccaggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgcaggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaaggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgcaggtggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggaccaggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgcaggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaaggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgcaggtggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggaccaggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgca

SEQ ID NO: 2715 - DNA, 2835 bp, Artificial Sequence
  Description of Artificial Sequence: Synthetic polynucleotide
ggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgcaggtggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggaccaggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgcaggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaaggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgcaggtggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggaccaggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgcaggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaaggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgcaggtggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggaccaggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgcaggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaa

SEQ ID NO: 2716 - protein, 155 aa, Argiope bruennichi
GSQGPGSGGQQGPGGQGPYGPSAAAAAAAAAGGYGPGAGQRSQGPGGQGPYGPGAGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQ

SEQ ID NO: 2717 - protein, 160 aa, Artificial Sequence
  Description of Artificial Sequence: Synthetic polypeptide
GPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGP

SEQ ID NO: 2718 - protein, 315 aa, Artificial Sequence
  Description of Artificial Sequence: Synthetic polypeptide
GSQGPGSGGQQGPGGQGPYGPSAAAAAAAAAGGYGPGAGQRSQGPGGQGPYGPGAGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGP

SEQ ID NO: 2719 - protein, 315 aa, Artificial Sequence
  Description of Artificial Sequence: Synthetic polypeptide
GGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQRSQGPGGQGPYGPGAGQQGPGSQGPGSGGQQGPGGQGPYGPSAAAAAAAA

SEQ ID NO: 2720 - protein, 315 aa, Artificial Sequence
  Description of Artificial Sequence: Synthetic polypeptide
GPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQRSQGPGGQGPYGPGAGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQ

SEQ ID NO: 2721 - protein, 945 aa, Artificial Sequence
  Description of Artificial Sequence: Synthetic polypeptide
GSQGPGSGGQQGPGGQGPYGPSAAAAAAAAAGGYGPGAGQRSQGPGGQGPYGPGAGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQRSQGPGGQGPYGPGAGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQRSQGPGGQGPYGPGAGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGP

SEQ ID NO: 2722 - protein, 945 aa, Artificial Sequence
  Description of Artificial Sequence: Synthetic polypeptide
GGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQRSQGPGGQGPYGPGAGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQRSQGPGGQGPYGPGAGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQRSQGPGGQGPYGPGAGQQGPGSQGPGSGGQQGPGGQGPYGPSAAAAAAAA

SEQ ID NO: 2723 - protein, 945 aa, Artificial Sequence
  Description of Artificial Sequence: Synthetic polypeptide
GPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQRSQGPGGQGPYGPGAGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQRSQGPGGQGPYGPGAGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQRSQGPGGQGPYGPGAGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQ

SEQ ID NO: 2724 - DNA, 2604 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtggtgcaggtcaaagaggttatggaggactaggtaatcaaggagctggtcgcggaggattaggaggtcaaggagctggtgctgccgccgctgctgctgctggaggtgcaggacagggtggatacggtggtcttggtaatcagggagcaggtcgaggtggacagggcgccgcggctgccgctggtggagccggacaaggtggttatggtggcttaggtagtcaaggtgctggtagaggaggtcagggagctggagctgctgccgccgcagcagtaggagctggtcaagaaggtatcagaggacaaggagctggtcagggtggttatggaggcttaggatctcagggtagcggtagaggaggattaggtggtcaaggagcaggtgctgccgctgccgctgctggtggagctggacaaggtggtttaggtggtcaaggtgcaggccagggagccggtgccgctgcggcagctgctggtggtgttagacagggaggctatggtggcttaggatcccagggtgctggccgaggtggtcagggagcaggtgctgcagcagccgctgcaggtggtgcaggtcaaagaggttatggaggactaggtaatcaaggagctggtcgcggaggattaggaggtcaaggagctggtgctgccgccgctgctgctgctggaggtgcaggacagggtggatacggtggtcttggtaatcagggagcaggtcgaggtggacagggcgccgcggctgccgctggtggagccggacaaggtggttatggtggcttaggtagtcaaggtgctggtagaggaggtcagggagctggagctgctgccgccgcagcagtaggagctggtcaagaaggtatcagaggacaaggagctggtcagggtggttatggaggcttaggatctcagggtagcggtagaggaggattaggtggtcaaggagcaggtgctgccgctgccgctgctggtggagctggacaaggtggtttaggtggtcaaggtgcaggccagggagccggtgccgctgcggcagctgctggtggtgttagacagggaggctatggtggcttaggatcccagggtgctggccgaggtggtcagggagcaggtgctgcagcagccgctgcaggtggtgcaggtcaaagaggttatggaggactaggtaatcaaggagctggtcgcggaggattaggaggtcaaggagctggtgctgccgccgctgctgctgctggaggtgcaggacagggtggatacggtggtcttggtaatcagggagcaggtcgaggtggacagggcgccgcggctgccgctggtggagccggacaaggtggttatggtggcttaggtagtcaaggtgctggtagaggaggtcagggagctggagctgctgccgccgcagcagtaggagctggtcaagaaggtatcagaggacaaggagctggtcagggtggttatggaggcttaggatctcagggtagcggtagaggaggattaggtggtcaaggagcaggtgctgccgctgccgctgctggtggagctggacaaggtggtttaggtggtcaaggtgcaggccagggagccggtgccgctgcggcagctgctggtggtgttagacagggaggctatggtggcttaggatcccagggtgctggccgaggtggtcagggagcaggtgctgcagcagccgctgcaggtggtgcaggtcaaagaggttatggaggactaggtaatcaaggagctggtcgcggaggattaggaggtcaaggagctggtgctgccgccgctgctgctgctggaggtgcaggacagggtggatacggtggtcttggtaatcagggagcaggtcgaggtggacagggcgccgcggctgccgctggtggagccggacaaggtggttatggtggcttaggtagtcaaggtgctggtagaggaggtcagggagctggagctgctgccgccgcagcagtaggagctggtcaagaaggtatcagaggacaaggagctggtcagggtggttatggaggcttaggatctcagggtagcggtagaggaggattaggtggtcaaggagcaggtgctgccgctgccgctgctggtggagctggacaaggtggtttaggtggtcaaggtgcaggccagggagccggtgccgctgcggcagctgctggtggtgttagacagggaggctatggtggcttaggatcccagggtgctggccgaggtggtcagggagcaggtgctgcagcagccgctgcaggtgactacaaagatgacgacgataaagattacaaagacgatgacgataaggactataaagatgatgacgacaaataataa

SEQ ID NO: 2725 - DNA, 3264 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggttcaggtgctggtcaaggtaccggtgctggtgctggtgctgctgctgcagcagccggtgccgcaggtagtggagctggtcaaggtgctggatctggagcaggcgcggctgcagcggcggccgcggcttccgctgcaggtgcgggccaaggtgctggatcaggtagcggagctggtgcggctgcggctgctgcggccgccgctggtgctggccaaggagctggaagcggatccggagccggcgcggctgccgctgctgccgcagcagccgcagcagctcaacaacaacaacaacagcaagcagcagctgctgcagcagctgccgctgcagccgcagctggttctggtcaaggtgcctctttcggagtaacgcaacaattcggtgcaccatctggtgctgcctcctctgctgctgccgctgctgctgcagcggctgccgccgctgctggcagtggtgcaggccaagaagctggcacaggtgctggtgcagccgcggctgctgcagccgcaggagcagccggatcgggtgcaggtcaaggcgctggaagtggagccggtgctgctgctgctgcggctgcagctgcctcagctgctggcgcgggacaaggtgctggttctggttcaggagctggtgctgccgcagctgctgctgctgccgccgctgcggcacaacagcagcagcagcagcaagcggcagcagctgcagctgctgccgctgcagctgccgcaggttcaggtgctggtcaaggtaccggtgctggtgctggtgctgctgctgcagcagccggtgccgcaggtagtggagctggtcaaggtgctggatctggagcaggcgcggctgcagcggcggccgcggcttccgctgcaggtgcgggccaaggtgctggatcaggtagcggagctggtgcggctgcggctgctgcggccgccgctggtgctggccaaggagctggaagcggatccggagccggcgcggctgccgctgctgccgcagcagccgcagcagctcaacaacaacaacaacagcaagcagcagctgctgcagcagctgccgctgcagccgcagctggttctggtcaaggtgcctctttcggagtaacgcaacaattcggtgcaccatctggtgctgcctcctctgctgctgccgctgctgctgcagcggctgccgccgctgctggcagtggtgcaggccaagaagctggcacaggtgctggtgcagccgcggctgctgcagccgcaggagcagccggatcgggtgcaggtcaaggcgctggaagtggagccggtgctgctgctgctgcggctgcagctgcctcagctgctggcgcgggacaaggtgctggttctggttcaggagctggtgctgccgcagctgctgctgctgccgccgctgcggcacaacagcagcagcagcagcaagcggcagcagctgcagctgctgccgctgcagctgccgcaggttcaggtgctggtcaaggtaccggtgctggtgctggtgctgctgctgcagcagccggtgccgcaggtagtggagctggtcaaggtgctggatctggagcaggcgcggctgcagcggcggccgcggcttccgctgcaggtgcgggccaaggtgctggatcaggtagcggagctggtgcggctgcggctgctgcggccgccgctggtgctggccaaggagctggaagcggatccggagccggcgcggctgccgctgctgccgcagcagccgcagcagctcaacaacaacaacaacagcaagcagcagctgctgcagcagctgccgctgcagccgcagctggttctggtcaaggtgcctctttcggagtaacgcaacaattcggtgcaccatctggtgctgcctcctctgctgctgccgctgctgctgcagcggctgccgccgctgctggcagtggtgcaggccaagaagctggcacaggtgctggtgcagccgcggctgctgcagccgcaggagcagccggatcgggtgcaggtcaaggcgctggaagtggagccggtgctgctgctgctgcggctgcagctgcctcagctgctggcgcgggacaaggtgctggttctggttcaggagctggtgctgccgcagctgctgctgctgccgccgctgcggcacaacagcagcagcagcagcaagcggcagcagctgcagctgctgccgctgcagctgccgcaggttcaggtgctggtcaaggtaccggtgctggtgctggtgctgctgctgcagcagccggtgccgcaggtagtggagctggtcaaggtgctggatctggagcaggcgcggctgcagcggcggccgcggcttccgctgcaggtgcgggccaaggtgctggatcaggtagcggagctggtgcggctgcggctgctgcggccgccgctggtgctggccaaggagctggaagcggatccggagccggcgcggctgccgctgctgccgcagcagccgcagcagctcaacaacaacaacaacagcaagcagcagctgctgcagcagctgccgctgcagccgcagctggttctggtcaaggtgcctctttcggagtaacgcaacaattcggtgcaccatctggtgctgcctcctctgctgctgccgctgctgctgcagcggctgccgccgctgctggcagtggtgcaggccaagaagctggcacaggtgctggtgcagccgcggctgctgcagccgcaggagcagccggatcgggtgcaggtcaaggcgctggaagtggagccggtgctgctgctgctgcggctgcagctgcctcagctgctggcgcgggacaaggtgctggttctggttcaggagctggtgctgccgcagctgctgctgctgccgccgctgcggcacaacagcagcagcagcagcaagcggcagcagctgcagctgctgccgctgcagctgccgcaggtgactacaaagatgacgacgataaagattacaaagacgatgacgataaggactataaagatgatgacgacaaataataa

SEQ ID NO: 2726 - DNA, 3084 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtgccggatctggtcaaggtggttacggtggccagggaggactgggaggttatggacaaggtgccggtgccggcgctgcagcaggagcctcaggctcaggctctggtggcgctggtcaaggaggtttaggcggttacggccaaggtgctggtgcaggtgcggctgcagcggctgcaggagctagcggagccggccaaggaggattcggaccatatggttcctcttatcaaagtagtacatcttactcagttacttctcagggagctgctggtggactcggtggatatggtcagggttccggcgctggagccgcagctgccggtgcggcaggacaaggtggtcaaggaggatatggccaaggtgcaggagcgggtgctggagcaggtgctggacaaggtggcctgggtggatacggtcaaggtgccggttcatctgctgcatctgctgccgctgcaggtgccggatctggtcaaggtggttacggtggccagggaggactgggaggttatggacaaggtgccggtgccggcgctgcagcaggagcctcaggctcaggctctggtggcgctggtcaaggaggtttaggcggttacggccaaggtgctggtgcaggtgcggctgcagcggctgcaggagctagcggagccggccaaggaggattcggaccatatggttcctcttatcaaagtagtacatcttactcagttacttctcagggagctgctggtggactcggtggatatggtcagggttccggcgctggagccgcagctgccggtgcggcaggacaaggtggtcaaggaggatatggccaaggtgcaggagcgggtgctggagcaggtgctggacaaggtggcctgggtggatacggtcaaggtgccggttcatctgctgcatctgctgccgctgcaggtgccggatctggtcaaggtggttacggtggccagggaggactgggaggttatggacaaggtgccggtgccggcgctgcagcaggagcctcaggctcaggctctggtggcgctggtcaaggaggtttaggcggttacggccaaggtgctggtgcaggtgcggctgcagcggctgcaggagctagcggagccggccaaggaggattcggaccatatggttcctcttatcaaagtagtacatcttactcagttacttctcagggagctgctggtggactcggtggatatggtcagggttccggcgctggagccgcagctgccggtgcggcaggacaaggtggtcaaggaggatatggccaaggtgcaggagcgggtgctggagcaggtgctggacaaggtggcctgggtggatacggtcaaggtgccggttcatctgctgcatctgctgccgctgcaggtgccggatctggtcaaggtggttacggtggccagggaggactgggaggttatggacaaggtgccggtgccggcgctgcagcaggagcctcaggctcaggctctggtggcgctggtcaaggaggtttaggcggttacggccaaggtgctggtgcaggtgcggctgcagcggctgcaggagctagcggagccggccaaggaggattcggaccatatggttcctcttatcaaagtagtacatcttactcagttacttctcagggagctgctggtggactcggtggatatggtcagggttccggcgctggagccgcagctgccggtgcggcaggacaaggtggtcaaggaggatatggccaaggtgcaggagcgggtgctggagcaggtgctggacaaggtggcctgggtggatacggtcaaggtgccggttcatctgctgcatctgctgccgctgcaggtgccggatctggtcaaggtggttacggtggccagggaggactgggaggttatggacaaggtgccggtgccggcgctgcagcaggagcctcaggctcaggctctggtggcgctggtcaaggaggtttaggcggttacggccaaggtgctggtgcaggtgcggctgcagcggctgcaggagctagcggagccggccaaggaggattcggaccatatggttcctcttatcaaagtagtacatcttactcagttacttctcagggagctgctggtggactcggtggatatggtcagggttccggcgctggagccgcagctgccggtgcggcaggacaaggtggtcaaggaggatatggccaaggtgcaggagcgggtgctggagcaggtgctggacaaggtggcctgggtggatacggtcaaggtgccggttcatctgctgcatctgctgccgctgcaggtgccggatctggtcaaggtggttacggtggccagggaggactgggaggttatggacaaggtgccggtgccggcgctgcagcaggagcctcaggctcaggctctggtggcgctggtcaaggaggtttaggcggttacggccaaggtgctggtgcaggtgcggctgcagcggctgcaggagctagcggagccggccaaggaggattcggaccatatggttcctcttatcaaagtagtacatcttactcagttacttctcagggagctgctggtggactcggtggatatggtcagggttccggcgctggagccgcagctgccggtgcggcaggacaaggtggtcaaggaggatatggccaaggtgcaggagcgggtgctggagcaggtgctggacaaggtggcctgggtggatacggtcaaggtgccggttcatctgctgcatctgctgccgctgcaggtgactacaaagatgacgacgataaagattacaaagacgatgacgataaggactataaagatgatgacgacaaataataa

SEQ ID NO: 2727 - DNA, 2868 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtgcaggagctggatacggaggtcaagtcggttacggccagggtgctggcgcctcagcaggtgccgccgcagctggagccggcgccggatatggaggacaggctggttacggacaaggagccggtggatccgctggtgcagcagcagctggcgctggtgctggtagacaagcaggttacggtcagggtgcaggagcatctgctcgtgcagcagccgctggagctggcacgggatatggtcagggtgccggtgcatccgctggagccgcagcagctggtgctggtgctggttcccaggtgggatacggacaaggtgctggtgcatcctccggtgctgctgctgctgcgggtgctggtgcaggatacggcggtcaagttggttacgagcaaggcgcaggagcttcagctggagctgaagccgcagcttcatcagctggtgccggatatggtggtcaggccggttatggacaaggcgctggcgcctctgcaggtgcagcagccgcaggtgcaggagctggatacggaggtcaagtcggttacggccagggtgctggcgcctcagcaggtgccgccgcagctggagccggcgccggatatggaggacaggctggttacggacaaggagccggtggatccgctggtgcagcagcagctggcgctggtgctggtagacaagcaggttacggtcagggtgcaggagcatctgctcgtgcagcagccgctggagctggcacgggatatggtcagggtgccggtgcatccgctggagccgcagcagctggtgctggtgctggttcccaggtgggatacggacaaggtgctggtgcatcctccggtgctgctgctgctgcgggtgctggtgcaggatacggcggtcaagttggttacgagcaaggcgcaggagcttcagctggagctgaagccgcagcttcatcagctggtgccggatatggtggtcaggccggttatggacaaggcgctggcgcctctgcaggtgcagcagccgcaggtgcaggagctggatacggaggtcaagtcggttacggccagggtgctggcgcctcagcaggtgccgccgcagctggagccggcgccggatatggaggacaggctggttacggacaaggagccggtggatccgctggtgcagcagcagctggcgctggtgctggtagacaagcaggttacggtcagggtgcaggagcatctgctcgtgcagcagccgctggagctggcacgggatatggtcagggtgccggtgcatccgctggagccgcagcagctggtgctggtgctggttcccaggtgggatacggacaaggtgctggtgcatcctccggtgctgctgctgctgcgggtgctggtgcaggatacggcggtcaagttggttacgagcaaggcgcaggagcttcagctggagctgaagccgcagcttcatcagctggtgccggatatggtggtcaggccggttatggacaaggcgctggcgcctctgcaggtgcagcagccgcaggtgcaggagctggatacggaggtcaagtcggttacggccagggtgctggcgcctcagcaggtgccgccgcagctggagccggcgccggatatggaggacaggctggttacggacaaggagccggtggatccgctggtgcagcagcagctggcgctggtgctggtagacaagcaggttacggtcagggtgcaggagcatctgctcgtgcagcagccgctggagctggcacgggatatggtcagggtgccggtgcatccgctggagccgcagcagctggtgctggtgctggttcccaggtgggatacggacaaggtgctggtgcatcctccggtgctgctgctgctgcgggtgctggtgcaggatacggcggtcaagttggttacgagcaaggcgcaggagcttcagctggagctgaagccgcagcttcatcagctggtgccggatatggtggtcaggccggttatggacaaggcgctggcgcctctgcaggtgcagcagccgcaggtgcaggagctggatacggaggtcaagtcggttacggccagggtgctggcgcctcagcaggtgccgccgcagctggagccggcgccggatatggaggacaggctggttacggacaaggagccggtggatccgctggtgcagcagcagctggcgctggtgctggtagacaagcaggttacggtcagggtgcaggagcatctgctcgtgcagcagccgctggagctggcacgggatatggtcagggtgccggtgcatccgctggagccgcagcagctggtgctggtgctggttcccaggtgggatacggacaaggtgctggtgcatcctccggtgctgctgctgctgcgggtgctggtgcaggatacggcggtcaagttggttacgagcaaggcgcaggagcttcagctggagctgaagccgcagcttcatcagctggtgccggatatggtggtcaggccggttatggacaaggcgctggcgcctctgcaggtgcagcagccgcaggtgactacaaagatgacgacgataaagattacaaagacgatgacgataaggactataaagatgatgacgacaaataataa

SEQ ID NO: 2728 - DNA, 2763 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtgcaggagccggaggagctggttatggaagaggtgctggagcgggagctggagcagcagcaggagctggtgcaggagctgctgccggagccggtgccggagccggtggttacggaggtcaaggtggttatggcgcaggagccggagccggcgctgcggctgctgccggtgccggtgctggtggcgccgctggctattccagaggtggaagagctggagcagccggtgcaggtgctggagcagcagctggtgctggagccggagctggtggttacggtggacaaggcggttacggtgctggtgcaggagcaggtgctgcggctgcggcaggtgcaggatcaggtggtgccggcggatatggtaggggcgccggtgcaggagcggccgctggtgctggtgcagcagccggcgctggagccggtgctggaggatatggaggtcagggaggttacggtgctggagcaggagccgctgcagcagcaggtgcaggagccggaggagctggttatggaagaggtgctggagcgggagctggagcagcagcaggagctggtgcaggagctgctgccggagccggtgccggagccggtggttacggaggtcaaggtggttatggcgcaggagccggagccggcgctgcggctgctgccggtgccggtgctggtggcgccgctggctattccagaggtggaagagctggagcagccggtgcaggtgctggagcagcagctggtgctggagccggagctggtggttacggtggacaaggcggttacggtgctggtgcaggagcaggtgctgcggctgcggcaggtgcaggatcaggtggtgccggcggatatggtaggggcgccggtgcaggagcggccgctggtgctggtgcagcagccggcgctggagccggtgctggaggatatggaggtcagggaggttacggtgctggagcaggagccgctgcagcagcaggtgcaggagccggaggagctggttatggaagaggtgctggagcgggagctggagcagcagcaggagctggtgcaggagctgctgccggagccggtgccggagccggtggttacggaggtcaaggtggttatggcgcaggagccggagccggcgctgcggctgctgccggtgccggtgctggtggcgccgctggctattccagaggtggaagagctggagcagccggtgcaggtgctggagcagcagctggtgctggagccggagctggtggttacggtggacaaggcggttacggtgctggtgcaggagcaggtgctgcggctgcggcaggtgcaggatcaggtggtgccggcggatatggtaggggcgccggtgcaggagcggccgctggtgctggtgcagcagccggcgctggagccggtgctggaggatatggaggtcagggaggttacggtgctggagcaggagccgctgcagcagcaggtgcaggagccggaggagctggttatggaagaggtgctggagcgggagctggagcagcagcaggagctggtgcaggagctgctgccggagccggtgccggagccggtggttacggaggtcaaggtggttatggcgcaggagccggagccggcgctgcggctgctgccggtgccggtgctggtggcgccgctggctattccagaggtggaagagctggagcagccggtgcaggtgctggagcagcagctggtgctggagccggagctggtggttacggtggacaaggcggttacggtgctggtgcaggagcaggtgctgcggctgcggcaggtgcaggatcaggtggtgccggcggatatggtaggggcgccggtgcaggagcggccgctggtgctggtgcagcagccggcgctggagccggtgctggaggatatggaggtcagggaggttacggtgctggagcaggagccgctgcagcagcaggtgcaggagccggaggagctggttatggaagaggtgctggagcgggagctggagcagcagcaggagctggtgcaggagctgctgccggagccggtgccggagccggtggttacggaggtcaaggtggttatggcgcaggagccggagccggcgctgcggctgctgccggtgccggtgctggtggcgccgctggctattccagaggtggaagagctggagcagccggtgcaggtgctggagcagcagctggtgctggagccggagctggtggttacggtggacaaggcggttacggtgctggtgcaggagcaggtgctgcggctgcggcaggtgcaggatcaggtggtgccggcggatatggtaggggcgccggtgcaggagcggccgctggtgctggtgcagcagccggcgctggagccggtgctggaggatatggaggtcagggaggttacggtgctggagcaggagccgctgcagcagcaggtgactacaaagatgacgacgataaagattacaaagacgatgacgataaggactataaagatgatgacgacaaataataa

SEQ ID NO: 2729 - DNA, 2748 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtgcaggcgcaggcgctggtggagccggtggttacggtagaggagctggtgccggagccggtgcaggagccggagctgcagcaggacagggatatggttcaggagctggagcaggagccggtgcttctgcaggaggagctggtagttacggaagaggcgcaggagctggagctgcagccgcaagtggagctggtgcaggaggttacggtgccggtcagggatacggcgccggtgccggagccgttgctagcgctgctgccggagctggatcgggtgctggaggcgctggtggatatggtagaggcgccgtagctggatctggtgccggtgctggagccggagcaggtggtgctggaggatacggagcgggagccggtgccggtgctgcagccggcgctgtagccggtggaagtggaggatacggtggtcgtcaaggaggttactccgcaggtgctggcgccggagcagcagccgccgcaggtgcaggcgcaggcgctggtggagccggtggttacggtagaggagctggtgccggagccggtgcaggagccggagctgcagcaggacagggatatggttcaggagctggagcaggagccggtgcttctgcaggaggagctggtagttacggaagaggcgcaggagctggagctgcagccgcaagtggagctggtgcaggaggttacggtgccggtcagggatacggcgccggtgccggagccgttgctagcgctgctgccggagctggatcgggtgctggaggcgctggtggatatggtagaggcgccgtagctggatctggtgccggtgctggagccggagcaggtggtgctggaggatacggagcgggagccggtgccggtgctgcagccggcgctgtagccggtggaagtggaggatacggtggtcgtcaaggaggttactccgcaggtgctggcgccggagcagcagccgccgcaggtgcaggcgcaggcgctggtggagccggtggttacggtagaggagctggtgccggagccggtgcaggagccggagctgcagcaggacagggatatggttcaggagctggagcaggagccggtgcttctgcaggaggagctggtagttacggaagaggcgcaggagctggagctgcagccgcaagtggagctggtgcaggaggttacggtgccggtcagggatacggcgccggtgccggagccgttgctagcgctgctgccggagctggatcgggtgctggaggcgctggtggatatggtagaggcgccgtagctggatctggtgccggtgctggagccggagcaggtggtgctggaggatacggagcgggagccggtgccggtgctgcagccggcgctgtagccggtggaagtggaggatacggtggtcgtcaaggaggttactccgcaggtgctggcgccggagcagcagccgccgcaggtgcaggcgcaggcgctggtggagccggtggttacggtagaggagctggtgccggagccggtgcaggagccggagctgcagcaggacagggatatggttcaggagctggagcaggagccggtgcttctgcaggaggagctggtagttacggaagaggcgcaggagctggagctgcagccgcaagtggagctggtgcaggaggttacggtgccggtcagggatacggcgccggtgccggagccgttgctagcgctgctgccggagctggatcgggtgctggaggcgctggtggatatggtagaggcgccgtagctggatctggtgccggtgctggagccggagcaggtggtgctggaggatacggagcgggagccggtgccggtgctgcagccggcgctgtagccggtggaagtggaggatacggtggtcgtcaaggaggttactccgcaggtgctggcgccggagcagcagccgccgcaggtgcaggcgcaggcgctggtggagccggtggttacggtagaggagctggtgccggagccggtgcaggagccggagctgcagcaggacagggatatggttcaggagctggagcaggagccggtgcttctgcaggaggagctggtagttacggaagaggcgcaggagctggagctgcagccgcaagtggagctggtgcaggaggttacggtgccggtcagggatacggcgccggtgccggagccgttgctagcgctgctgccggagctggatcgggtgctggaggcgctggtggatatggtagaggcgccgtagctggatctggtgccggtgctggagccggagcaggtggtgctggaggatacggagcgggagccggtgccggtgctgcagccggcgctgtagccggtggaagtggaggatacggtggtcgtcaaggaggttactccgcaggtgctggcgccggagcagcagccgccgcaggtgactacaaagatgacgacgataaagattacaaagacgatgacgataaggactataaagatgatgacgacaaataataa

SEQ ID NO: 2730 - DNA, 2148 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtgctggatcaggcggagccggaggttatggtaggggtgccggtgccggtgccggcgccgccgctggtgcaggagccggtgcaggatcttatggaggacaaggtggttatggtgcgggagctggagcaggtgccgcagctgcagcgggagctggtgctggtgccggtggatacggtcgaggagctggtgccggagctggagctggagccggtgctgctgcaagagcaggagccggagctggaggtgcaggatacggcggccagggtggatatggagccggtgccggtgctggtgctgctgccgctgctggcgctggcgccggtggtgcaggaggatacggtagaggagcaggtgcaggtgctggtgctgcagcaggtgctggagccggagcaggtggttacggtggacaaagcggctacggtgcaggagcaggtgcagctgctgcagcaggtgctggatcaggcggagccggaggttatggtaggggtgccggtgccggtgccggcgccgccgctggtgcaggagccggtgcaggatcttatggaggacaaggtggttatggtgcgggagctggagcaggtgccgcagctgcagcgggagctggtgctggtgccggtggatacggtcgaggagctggtgccggagctggagctggagccggtgctgctgcaagagcaggagccggagctggaggtgcaggatacggcggccagggtggatatggagccggtgccggtgctggtgctgctgccgctgctggcgctggcgccggtggtgcaggaggatacggtagaggagcaggtgcaggtgctggtgctgcagcaggtgctggagccggagcaggtggttacggtggacaaagcggctacggtgcaggagcaggtgcagctgctgcagcaggtgctggatcaggcggagccggaggttatggtaggggtgccggtgccggtgccggcgccgccgctggtgcaggagccggtgcaggatcttatggaggacaaggtggttatggtgcgggagctggagcaggtgccgcagctgcagcgggagctggtgctggtgccggtggatacggtcgaggagctggtgccggagctggagctggagccggtgctgctgcaagagcaggagccggagctggaggtgcaggatacggcggccagggtggatatggagccggtgccggtgctggtgctgctgccgctgctggcgctggcgccggtggtgcaggaggatacggtagaggagcaggtgcaggtgctggtgctgcagcaggtgctggagccggagcaggtggttacggtggacaaagcggctacggtgcaggagcaggtgcagctgctgcagcaggtgctggatcaggcggagccggaggttatggtaggggtgccggtgccggtgccggcgccgccgctggtgcaggagccggtgcaggatcttatggaggacaaggtggttatggtgcgggagctggagcaggtgccgcagctgcagcgggagctggtgctggtgccggtggatacggtcgaggagctggtgccggagctggagctggagccggtgctgctgcaagagcaggagccggagctggaggtgcaggatacggcggccagggtggatatggagccggtgccggtgctggtgctgctgccgctgctggcgctggcgccggtggtgcaggaggatacggtagaggagcaggtgcaggtgctggtgctgcagcaggtgctggagccggagcaggtggttacggtggacaaagcggctacggtgcaggagcaggtgcagctgctgcagcaggtgactacaaagatgacgacgataaagattacaaagacgatgacgataaggactataaagatgatgacgacaaataataa

SEQ ID NO: 2731 - DNA, 2220 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtacaggaggagttggtggattgttcctatccagcggtgactttggacgaggtggtgctggagctggcgctggtgcggccgccgctagcgcagctgccgcatctagcgcagctgctggtgctagaggaggttccggattcggtgttggtacaggcggttttggacgtggcggagccggagcgggtactggtgctgctgctgccagtgcagccgccgcctctgctgcggctgcaggagctggtggagatggtggcctattcctgagtagtggagattttggacgtggaggagcgggcgctggcgctggagctgccgcagcctctgctgctgccgcatcatctgccgccgcaggagcacgtggtggatcaggattcggagttggaacgggcggatttggcagaggtggagcaggagatggagcttcagcagcggcggcatcggcagcagcagcttcagctgctgctgcaggtacaggaggagttggtggattgttcctatccagcggtgactttggacgaggtggtgctggagctggcgctggtgcggccgccgctagcgcagctgccgcatctagcgcagctgctggtgctagaggaggttccggattcggtgttggtacaggcggttttggacgtggcggagccggagcgggtactggtgctgctgctgccagtgcagccgccgcctctgctgcggctgcaggagctggtggagatggtggcctattcctgagtagtggagattttggacgtggaggagcgggcgctggcgctggagctgccgcagcctctgctgctgccgcatcatctgccgccgcaggagcacgtggtggatcaggattcggagttggaacgggcggatttggcagaggtggagcaggagatggagcttcagcagcggcggcatcggcagcagcagcttcagctgctgctgcaggtacaggaggagttggtggattgttcctatccagcggtgactttggacgaggtggtgctggagctggcgctggtgcggccgccgctagcgcagctgccgcatctagcgcagctgctggtgctagaggaggttccggattcggtgttggtacaggcggttttggacgtggcggagccggagcgggtactggtgctgctgctgccagtgcagccgccgcctctgctgcggctgcaggagctggtggagatggtggcctattcctgagtagtggagattttggacgtggaggagcgggcgctggcgctggagctgccgcagcctctgctgctgccgcatcatctgccgccgcaggagcacgtggtggatcaggattcggagttggaacgggcggatttggcagaggtggagcaggagatggagcttcagcagcggcggcatcggcagcagcagcttcagctgctgctgcaggtacaggaggagttggtggattgttcctatccagcggtgactttggacgaggtggtgctggagctggcgctggtgcggccgccgctagcgcagctgccgcatctagcgcagctgctggtgctagaggaggttccggattcggtgttggtacaggcggttttggacgtggcggagccggagcgggtactggtgctgctgctgccagtgcagccgccgcctctgctgcggctgcaggagctggtggagatggtggcctattcctgagtagtggagattttggacgtggaggagcgggcgctggcgctggagctgccgcagcctctgctgctgccgcatcatctgccgccgcaggagcacgtggtggatcaggattcggagttggaacgggcggatttggcagaggtggagcaggagatggagcttcagcagcggcggcatcggcagcagcagcttcagctgctgctgcaggtgactacaaagatgacgacgataaagattacaaagacgatgacgataaggactataaagatgatgacgacaaataataa

SEQ ID NO: 2732 - DNA, 2472 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtggtgcgggtcaaggcggttacggaggattaggaggtcaaggagccggtgctgctgctgccgctgcaggaggagccggacagggaggttacggtggtcaaggtgccggacaaggagcggctgccgctgcagcatcaggtgctggtcaaggaggctatgaaggtcctggtgcaggacaaggagctggtgctgcagctgccgcagccggtggtgccggccagggaggatatggtggtttgggcggacagggcgccggccaaggagctggtgcagccgcagccgccgctggcggtgccggacaaggtggttacggtggtcttggtggtcagggagcaggtcagggtgcaggagccgctgctgctgctgctggaggagctggtcaaggcggatatggaggtcaaggcgcaggtcaaggcgcagcagcagcagccgctggtggagccggacagggtggttacggcggcctaggttcaggacaaggaggttatggacgtcagggagctggtgccgcagccgcagcggccgctgcaggtggtgcgggtcaaggcggttacggaggattaggaggtcaaggagccggtgctgctgctgccgctgcaggaggagccggacagggaggttacggtggtcaaggtgccggacaaggagcggctgccgctgcagcatcaggtgctggtcaaggaggctatgaaggtcctggtgcaggacaaggagctggtgctgcagctgccgcagccggtggtgccggccagggaggatatggtggtttgggcggacagggcgccggccaaggagctggtgcagccgcagccgccgctggcggtgccggacaaggtggttacggtggtcttggtggtcagggagcaggtcagggtgcaggagccgctgctgctgctgctggaggagctggtcaaggcggatatggaggtcaaggcgcaggtcaaggcgcagcagcagcagccgctggtggagccggacagggtggttacggcggcctaggttcaggacaaggaggttatggacgtcagggagctggtgccgcagccgcagcggccgctgcaggtggtgcgggtcaaggcggttacggaggattaggaggtcaaggagccggtgctgctgctgccgctgcaggaggagccggacagggaggttacggtggtcaaggtgccggacaaggagcggctgccgctgcagcatcaggtgctggtcaaggaggctatgaaggtcctggtgcaggacaaggagctggtgctgcagctgccgcagccggtggtgccggccagggaggatatggtggtttgggcggacagggcgccggccaaggagctggtgcagccgcagccgccgctggcggtgccggacaaggtggttacggtggtcttggtggtcagggagcaggtcagggtgcaggagccgctgctgctgctgctggaggagctggtcaaggcggatatggaggtcaaggcgcaggtcaaggcgcagcagcagcagccgctggtggagccggacagggtggttacggcggcctaggttcaggacaaggaggttatggacgtcagggagctggtgccgcagccgcagcggccgctgcaggtggtgcgggtcaaggcggttacggaggattaggaggtcaaggagccggtgctgctgctgccgctgcaggaggagccggacagggaggttacggtggtcaaggtgccggacaaggagcggctgccgctgcagcatcaggtgctggtcaaggaggctatgaaggtcctggtgcaggacaaggagctggtgctgcagctgccgcagccggtggtgccggccagggaggatatggtggtttgggcggacagggcgccggccaaggagctggtgcagccgcagccgccgctggcggtgccggacaaggtggttacggtggtcttggtggtcagggagcaggtcagggtgcaggagccgctgctgctgctgctggaggagctggtcaaggcggatatggaggtcaaggcgcaggtcaaggcgcagcagcagcagccgctggtggagccggacagggtggttacggcggcctaggttcaggacaaggaggttatggacgtcagggagctggtgccgcagccgcagcggccgctgcaggtgactacaaagatgacgacgataaagattacaaagacgatgacgataaggactataaagatgatgacgacaaataataa

SEQ ID NO: 2733 - DNA, 2052 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtgctggcgctggagctggagtaggtgtgggcggtgcaggcggttacggtcagggttacggtgctggagctggagcaggagctggagctggagctggtgcaggtggagctggaggttacggccagggttatggagctggtgcagcagctgctgctggagctggtgctggtgcagctggtggctacggaggaggttcaggagcgggtgctggtggtgctggaggttatggtcaaggatacggtgcaggttctggagccggtgcgggagccgctgcagcggccggtgcatctgctggagccgctggtggctatggtggaggagctggagttggtgctggagctggcgctggtgctgcaggtggttacggccaatcatacggatcaggtgctggagcaggtgcaggagcaggtgctgctgctgccgcaggtgctggcgctggagctggagtaggtgtgggcggtgcaggcggttacggtcagggttacggtgctggagctggagcaggagctggagctggagctggtgcaggtggagctggaggttacggccagggttatggagctggtgcagcagctgctgctggagctggtgctggtgcagctggtggctacggaggaggttcaggagcgggtgctggtggtgctggaggttatggtcaaggatacggtgcaggttctggagccggtgcgggagccgctgcagcggccggtgcatctgctggagccgctggtggctatggtggaggagctggagttggtgctggagctggcgctggtgctgcaggtggttacggccaatcatacggatcaggtgctggagcaggtgcaggagcaggtgctgctgctgccgcaggtgctggcgctggagctggagtaggtgtgggcggtgcaggcggttacggtcagggttacggtgctggagctggagcaggagctggagctggagctggtgcaggtggagctggaggttacggccagggttatggagctggtgcagcagctgctgctggagctggtgctggtgcagctggtggctacggaggaggttcaggagcgggtgctggtggtgctggaggttatggtcaaggatacggtgcaggttctggagccggtgcgggagccgctgcagcggccggtgcatctgctggagccgctggtggctatggtggaggagctggagttggtgctggagctggcgctggtgctgcaggtggttacggccaatcatacggatcaggtgctggagcaggtgcaggagcaggtgctgctgctgccgcaggtgctggcgctggagctggagtaggtgtgggcggtgcaggcggttacggtcagggttacggtgctggagctggagcaggagctggagctggagctggtgcaggtggagctggaggttacggccagggttatggagctggtgcagcagctgctgctggagctggtgctggtgcagctggtggctacggaggaggttcaggagcgggtgctggtggtgctggaggttatggtcaaggatacggtgcaggttctggagccggtgcgggagccgctgcagcggccggtgcatctgctggagccgctggtggctatggtggaggagctggagttggtgctggagctggcgctggtgctgcaggtggttacggccaatcatacggatcaggtgctggagcaggtgcaggagcaggtgctgctgctgccgcaggtgactacaaagatgacgacgataaagattacaaagacgatgacgataaggactataaagatgatgacgacaaataataa

SEQ ID NO: 2734 - protein, 866 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGGAGQRGYGGLGNQGAGRGGLGGQGAGAAAAAAAGGAGQGGYGGLGNQGAGRGGQGAAAAAGGAGQGGYGGLGSQGAGRGGQGAGAAAAAAVGAGQEGIRGQGAGQGGYGGLGSQGSGRGGLGGQGAGAAAAAAGGAGQGGLGGQGAGQGAGAAAAAAGGVRQGGYGGLGSQGAGRGGQGAGAAAAAAGGAGQRGYGGLGNQGAGRGGLGGQGAGAAAAAAAGGAGQGGYGGLGNQGAGRGGQGAAAAAGGAGQGGYGGLGSQGAGRGGQGAGAAAAAAVGAGQEGIRGQGAGQGGYGGLGSQGSGRGGLGGQGAGAAAAAAGGAGQGGLGGQGAGQGAGAAAAAAGGVRQGGYGGLGSQGAGRGGQGAGAAAAAAGGAGQRGYGGLGNQGAGRGGLGGQGAGAAAAAAAGGAGQGGYGGLGNQGAGRGGQGAAAAAGGAGQGGYGGLGSQGAGRGGQGAGAAAAAAVGAGQEGIRGQGAGQGGYGGLGSQGSGRGGLGGQGAGAAAAAAGGAGQGGLGGQGAGQGAGAAAAAAGGVRQGGYGGLGSQGAGRGGQGAGAAAAAAGGAGQRGYGGLGNQGAGRGGLGGQGAGAAAAAAAGGAGQGGYGGLGNQGAGRGGQGAAAAAGGAGQGGYGGLGSQGAGRGGQGAGAAAAAAVGAGQEGIRGQGAGQGGYGGLGSQGSGRGGLGGQGAGAAAAAAGGAGQGGLGGQGAGQGAGAAAAAAGGVRQGGYGGLGSQGAGRGGQGAGAAAAAAGDYKDDDDKDYKDDDDKDYKDDDDK

SEQ ID NO: 2735 - protein, 1086 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGSGAGQGTGAGAGAAAAAAGAAGSGAGQGAGSGAGAAAAAAAASAAGAGQGAGSGSGAGAAAAAAAAAGAGQGAGSGSGAGAAAAAAAAAAAAQQQQQQQAAAAAAAAAAAAAGSGQGASFGVTQQFGAPSGAASSAAAAAAAAAAAAAGSGAGQEAGTGAGAAAAAAAAGAAGSGAGQGAGSGAGAAAAAAAAASAAGAGQGAGSGSGAGAAAAAAAAAAAAQQQQQQQAAAAAAAAAAAAAGSGAGQGTGAGAGAAAAAAGAAGSGAGQGAGSGAGAAAAAAAASAAGAGQGAGSGSGAGAAAAAAAAAGAGQGAGSGSGAGAAAAAAAAAAAAQQQQQQQAAAAAAAAAAAAAGSGQGASFGVTQQFGAPSGAASSAAAAAAAAAAAAAGSGAGQEAGTGAGAAAAAAAAGAAGSGAGQGAGSGAGAAAAAAAAASAAGAGQGAGSGSGAGAAAAAAAAAAAAQQQQQQQAAAAAAAAAAAAAGSGAGQGTGAGAGAAAAAAGAAGSGAGQGAGSGAGAAAAAAAASAAGAGQGAGSGSGAGAAAAAAAAAGAGQGAGSGSGAGAAAAAAAAAAAAQQQQQQQAAAAAAAAAAAAAGSGQGASFGVTQQFGAPSGAASSAAAAAAAAAAAAAGSGAGQEAGTGAGAAAAAAAAGAAGSGAGQGAGSGAGAAAAAAAAASAAGAGQGAGSGSGAGAAAAAAAAAAAAQQQQQQQAAAAAAAAAAAAAGSGAGQGTGAGAGAAAAAAGAAGSGAGQGAGSGAGAAAAAAAASAAGAGQGAGSGSGAGAAAAAAAAAGAGQGAGSGSGAGAAAAAAAAAAAAQQQQQQQAAAAAAAAAAAAAGSGQGASFGVTQQFGAPSGAASSAAAAAAAAAAAAAGSGAGQEAGTGAGAAAAAAAAGAAGSGAGQGAGSGAGAAAAAAAAASAAGAGQGAGSGSGAGAAAAAAAAAAAAQQQQQQQAAAAAAAAAAAAAGDYKDDDDKDYKDDDDKDYKDDDDK

SEQ ID NO: 2736 - protein, 1026 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGAGSGQGGYGGQGGLGGYGQGAGAGAAAGASGSGSGGAGQGGLGGYGQGAGAGAAAAAAGASGAGQGGFGPYGSSYQSSTSYSVTSQGAAGGLGGYGQGSGAGAAAAGAAGQGGQGGYGQGAGAGAGAGAGQGGLGGYGQGAGSSAASAAAAGAGSGQGGYGGQGGLGGYGQGAGAGAAAGASGSGSGGAGQGGLGGYGQGAGAGAAAAAAGASGAGQGGFGPYGSSYQSSTSYSVTSQGAAGGLGGYGQGSGAGAAAAGAAGQGGQGGYGQGAGAGAGAGAGQGGLGGYGQGAGSSAASAAAAGAGSGQGGYGGQGGLGGYGQGAGAGAAAGASGSGSGGAGQGGLGGYGQGAGAGAAAAAAGASGAGQGGFGPYGSSYQSSTSYSVTSQGAAGGLGGYGQGSGAGAAAAGAAGQGGQGGYGQGAGAGAGAGAGQGGLGGYGQGAGSSAASAAAAGAGSGQGGYGGQGGLGGYGQGAGAGAAAGASGSGSGGAGQGGLGGYGQGAGAGAAAAAAGASGAGQGGFGPYGSSYQSSTSYSVTSQGAAGGLGGYGQGSGAGAAAAGAAGQGGQGGYGQGAGAGAGAGAGQGGLGGYGQGAGSSAASAAAAGAGSGQGGYGGQGGLGGYGQGAGAGAAAGASGSGSGGAGQGGLGGYGQGAGAGAAAAAAGASGAGQGGFGPYGSSYQSSTSYSVTSQGAAGGLGGYGQGSGAGAAAAGAAGQGGQGGYGQGAGAGAGAGAGQGGLGGYGQGAGSSAASAAAAGAGSGQGGYGGQGGLGGYGQGAGAGAAAGASGSGSGGAGQGGLGGYGQGAGAGAAAAAAGASGAGQGGFGPYGSSYQSSTSYSVTSQGAAGGLGGYGQGSGAGAAAAGAAGQGGQGGYGQGAGAGAGAGAGQGGLGGYGQGAGSSAASAAAAGDYKDDDDKDYKDDDDKDYKDDDDK

SEQ ID NO: 2737 - protein, 954 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGAGAGYGGQVGYGQGAGASAGAAAAGAGAGYGGQAGYGQGAGGSAGAAAAGAGAGRQAGYGQGAGASARAAAAGAGTGYGQGAGASAGAAAAGAGAGSQVGYGQGAGASSGAAAAAGAGAGYGGQVGYEQGAGASAGAEAAASSAGAGYGGQAGYGQGAGASAGAAAAGAGAGYGGQVGYGQGAGASAGAAAAGAGAGYGGQAGYGQGAGGSAGAAAAGAGAGRQAGYGQGAGASARAAAAGAGTGYGQGAGASAGAAAAGAGAGSQVGYGQGAGASSGAAAAAGAGAGYGGQVGYEQGAGASAGAEAAASSAGAGYGGQAGYGQGAGASAGAAAAGAGAGYGGQVGYGQGAGASAGAAAAGAGAGYGGQAGYGQGAGGSAGAAAAGAGAGRQAGYGQGAGASARAAAAGAGTGYGQGAGASAGAAAAGAGAGSQVGYGQGAGASSGAAAAAGAGAGYGGQVGYEQGAGASAGAEAAASSAGAGYGGQAGYGQGAGASAGAAAAGAGAGYGGQVGYGQGAGASAGAAAAGAGAGYGGQAGYGQGAGGSAGAAAAGAGAGRQAGYGQGAGASARAAAAGAGTGYGQGAGASAGAAAAGAGAGSQVGYGQGAGASSGAAAAAGAGAGYGGQVGYEQGAGASAGAEAAASSAGAGYGGQAGYGQGAGASAGAAAAGAGAGYGGQVGYGQGAGASAGAAAAGAGAGYGGQAGYGQGAGGSAGAAAAGAGAGRQAGYGQGAGASARAAAAGAGTGYGQGAGASAGAAAAGAGAGSQVGYGQGAGASSGAAAAAGAGAGYGGQVGYEQGAGASAGAEAAASSAGAGYGGQAGYGQGAGASAGAAAAGDYKDDDDKDYKDDDDKDYKDDDDK

SEQ ID NO: 2738 - protein, 919 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGAGAGGAGYGRGAGAGAGAAAGAGAGAAAGAGAGAGGYGGQGGYGAGAGAGAAAAAGAGAGGAAGYSRGGRAGAAGAGAGAAAGAGAGAGGYGGQGGYGAGAGAGAAAAAGAGSGGAGGYGRGAGAGAAAGAGAAAGAGAGAGGYGGQGGYGAGAGAAAAAGAGAGGAGYGRGAGAGAGAAAGAGAGAAAGAGAGAGGYGGQGGYGAGAGAGAAAAAGAGAGGAAGYSRGGRAGAAGAGAGAAAGAGAGAGGYGGQGGYGAGAGAGAAAAAGAGSGGAGGYGRGAGAGAAAGAGAAAGAGAGAGGYGGQGGYGAGAGAAAAAGAGAGGAGYGRGAGAGAGAAAGAGAGAAAGAGAGAGGYGGQGGYGAGAGAGAAAAAGAGAGGAAGYSRGGRAGAAGAGAGAAAGAGAGAGGYGGQGGYGAGAGAGAAAAAGAGSGGAGGYGRGAGAGAAAGAGAAAGAGAGAGGYGGQGGYGAGAGAAAAAGAGAGGAGYGRGAGAGAGAAAGAGAGAAAGAGAGAGGYGGQGGYGAGAGAGAAAAAGAGAGGAAGYSRGGRAGAAGAGAGAAAGAGAGAGGYGGQGGYGAGAGAGAAAAAGAGSGGAGGYGRGAGAGAAAGAGAAAGAGAGAGGYGGQGGYGAGAGAAAAAGAGAGGAGYGRGAGAGAGAAAGAGAGAAAGAGAGAGGYGGQGGYGAGAGAGAAAAAGAGAGGAAGYSRGGRAGAAGAGAGAAAGAGAGAGGYGGQGGYGAGAGAGAAAAAGAGSGGAGGYGRGAGAGAAAGAGAAAGAGAGAGGYGGQGGYGAGAGAAAAAGDYKDDDDKDYKDDDDKDYKDDDDK

SEQ ID NO: 2739 - protein, 914 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGAGAGAGGAGGYGRGAGAGAGAGAGAAAGQGYGSGAGAGAGASAGGAGSYGRGAGAGAAAASGAGAGGYGAGQGYGAGAGAVASAAAGAGSGAGGAGGYGRGAVAGSGAGAGAGAGGAGGYGAGAGAGAAAGAVAGGSGGYGGRQGGYSAGAGAGAAAAAGAGAGAGGAGGYGRGAGAGAGAGAGAAAGQGYGSGAGAGAGASAGGAGSYGRGAGAGAAAASGAGAGGYGAGQGYGAGAGAVASAAAGAGSGAGGAGGYGRGAVAGSGAGAGAGAGGAGGYGAGAGAGAAAGAVAGGSGGYGGRQGGYSAGAGAGAAAAAGAGAGAGGAGGYGRGAGAGAGAGAGAAAGQGYGSGAGAGAGASAGGAGSYGRGAGAGAAAASGAGAGGYGAGQGYGAGAGAVASAAAGAGSGAGGAGGYGRGAVAGSGAGAGAGAGGAGGYGAGAGAGAAAGAVAGGSGGYGGRQGGYSAGAGAGAAAAAGAGAGAGGAGGYGRGAGAGAGAGAGAAAGQGYGSGAGAGAGASAGGAGSYGRGAGAGAAAASGAGAGGYGAGQGYGAGAGAVASAAAGAGSGAGGAGGYGRGAVAGSGAGAGAGAGGAGGYGAGAGAGAAAGAVAGGSGGYGGRQGGYSAGAGAGAAAAAGAGAGAGGAGGYGRGAGAGAGAGAGAAAGQGYGSGAGAGAGASAGGAGSYGRGAGAGAAAASGAGAGGYGAGQGYGAGAGAVASAAAGAGSGAGGAGGYGRGAVAGSGAGAGAGAGGAGGYGAGAGAGAAAGAVAGGSGGYGGRQGGYSAGAGAGAAAAAGDYKDDDDKDYKDDDDKDYKDDDDK

SEQ ID NO: 2740 - protein, 714 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGAGSGGAGGYGRGAGAGAGAAAGAGAGAGSYGGQGGYGAGAGAGAAAAAGAGAGAGGYGRGAGAGAGAGAGAAARAGAGAGGAGYGGQGGYGAGAGAGAAAAAGAGAGGAGGYGRGAGAGAGAAAGAGAGAGGYGGQSGYGAGAGAAAAAGAGSGGAGGYGRGAGAGAGAAAGAGAGAGSYGGQGGYGAGAGAGAAAAAGAGAGAGGYGRGAGAGAGAGAGAAARAGAGAGGAGYGGQGGYGAGAGAGAAAAAGAGAGGAGGYGRGAGAGAGAAAGAGAGAGGYGGQSGYGAGAGAAAAAGAGSGGAGGYGRGAGAGAGAAAGAGAGAGSYGGQGGYGAGAGAGAAAAAGAGAGAGGYGRGAGAGAGAGAGAAARAGAGAGGAGYGGQGGYGAGAGAGAAAAAGAGAGGAGGYGRGAGAGAGAAAGAGAGAGGYGGQSGYGAGAGAAAAAGAGSGGAGGYGRGAGAGAGAAAGAGAGAGSYGGQGGYGAGAGAGAAAAAGAGAGAGGYGRGAGAGAGAGAGAAARAGAGAGGAGYGGQGGYGAGAGAGAAAAAGAGAGGAGGYGRGAGAGAGAAAGAGAGAGGYGGQSGYGAGAGAAAAAGDYKDDDDKDYKDDDDKDYKDDDDK

SEQ ID NO: 2741 - protein, 738 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGTGGVGGLFLSSGDFGRGGAGAGAGAAAASAAAASSAAAGARGGSGFGVGTGGFGRGGAGAGTGAAAASAAAASAAAAGAGGDGGLFLSSGDFGRGGAGAGAGAAAASAAAASSAAAGARGGSGFGVGTGGFGRGGAGDGASAAAASAAAASAAAAGTGGVGGLFLSSGDFGRGGAGAGAGAAAASAAAASSAAAGARGGSGFGVGTGGFGRGGAGAGTGAAAASAAAASAAAAGAGGDGGLFLSSGDFGRGGAGAGAGAAAASAAAASSAAAGARGGSGFGVGTGGFGRGGAGDGASAAAASAAAASAAAAGTGGVGGLFLSSGDFGRGGAGAGAGAAAASAAAASSAAAGARGGSGFGVGTGGFGRGGAGAGTGAAAASAAAASAAAAGAGGDGGLFLSSGDFGRGGAGAGAGAAAASAAAASSAAAGARGGSGFGVGTGGFGRGGAGDGASAAAASAAAASAAAAGTGGVGGLFLSSGDFGRGGAGAGAGAAAASAAAASSAAAGARGGSGFGVGTGGFGRGGAGAGTGAAAASAAAASAAAAGAGGDGGLFLSSGDFGRGGAGAGAGAAAASAAAASSAAAGARGGSGFGVGTGGFGRGGAGDGASAAAASAAAASAAAAGDYKDDDDKDYKDDDDKDYKDDDDK

SEQ ID NO: 2742 - protein, 822 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGGAGQGGYGGLGGQGAGAAAAAAGGAGQGGYGGQGAGQGAAAAAASGAGQGGYEGPGAGQGAGAAAAAAGGAGQGGYGGLGGQGAGQGAGAAAAAAGGAGQGGYGGLGGQGAGQGAGAAAAAAGGAGQGGYGGQGAGQGAAAAAAGGAGQGGYGGLGSGQGGYGRQGAGAAAAAAAAGGAGQGGYGGLGGQGAGAAAAAAGGAGQGGYGGQGAGQGAAAAAASGAGQGGYEGPGAGQGAGAAAAAAGGAGQGGYGGLGGQGAGQGAGAAAAAAGGAGQGGYGGLGGQGAGQGAGAAAAAAGGAGQGGYGGQGAGQGAAAAAAGGAGQGGYGGLGSGQGGYGRQGAGAAAAAAAAGGAGQGGYGGLGGQGAGAAAAAAGGAGQGGYGGQGAGQGAAAAAASGAGQGGYEGPGAGQGAGAAAAAAGGAGQGGYGGLGGQGAGQGAGAAAAAAGGAGQGGYGGLGGQGAGQGAGAAAAAAGGAGQGGYGGQGAGQGAAAAAAGGAGQGGYGGLGSGQGGYGRQGAGAAAAAAAAGGAGQGGYGGLGGQGAGAAAAAAGGAGQGGYGGQGAGQGAAAAAASGAGQGGYEGPGAGQGAGAAAAAAGGAGQGGYGGLGGQGAGQGAGAAAAAAGGAGQGGYGGLGGQGAGQGAGAAAAAAGGAGQGGYGGQGAGQGAAAAAAGGAGQGGYGGLGSGQGGYGRQGAGAAAAAAAAGDYKDDDDKDYKDDDDKDYKDDDDK

SEQ ID NO: 2743 - protein, 682 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGAGAGAGVGVGGAGGYGQGYGAGAGAGAGAGAGAGGAGGYGQGYGAGAAAAAGAGAGAAGGYGGGSGAGAGGAGGYGQGYGAGSGAGAGAAAAAGASAGAAGGYGGGAGVGAGAGAGAAGGYGQSYGSGAGAGAGAGAAAAAGAGAGAGVGVGGAGGYGQGYGAGAGAGAGAGAGAGGAGGYGQGYGAGAAAAAGAGAGAAGGYGGGSGAGAGGAGGYGQGYGAGSGAGAGAAAAAGASAGAAGGYGGGAGVGAGAGAGAAGGYGQSYGSGAGAGAGAGAAAAAGAGAGAGVGVGGAGGYGQGYGAGAGAGAGAGAGAGGAGGYGQGYGAGAAAAAGAGAGAAGGYGGGSGAGAGGAGGYGQGYGAGSGAGAGAAAAAGASAGAAGGYGGGAGVGAGAGAGAAGGYGQSYGSGAGAGAGAGAAAAAGAGAGAGVGVGGAGGYGQGYGAGAGAGAGAGAGAGGAGGYGQGYGAGAAAAAGAGAGAAGGYGGGSGAGAGGAGGYGQGYGAGSGAGAGAAAAAGASAGAAGGYGGGAGVGAGAGAGAAGGYGQSYGSGAGAGAGAGAAAAAGDYKDDDDKDYKDDDDKDYKDDDDK

SEQ ID NO: 2744 - DNA, 5073 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggaccaggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgcaggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaaggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgcaggtggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggaccaggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgcaggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaaggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgcaggtggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggaccaggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgcaggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaaggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgcaggtggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggaccaggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgcaggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaaggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgcaggtggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggaccaggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgcaggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaaggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgcaggtgactacaaagatgacgacgataaagattacaaagacgatgacgataaggactataaagatgatgacgacaaataataa

SEQ ID NO: 2745 - protein, 1689 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQRSQGPGGQGPYGPGAGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQRSQGPGGQGPYGPGAGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQRSQGPGGQGPYGPGAGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQRSQGPGGQGPYGPGAGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQRSQGPGGQGPYGPGAGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGDYKDDDDKDYKDDDDKDYKDDDDK

SEQ ID NO: 2746 - DNA, 1293 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggaccaggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgcaggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaaggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgcaggtgactacaaagatgacgacgataaagattacaaagacgatgacgataaggactataaagatgatgacgacaaataataa

SEQ ID NO: 2747 - DNA, 2238 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggaccaggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgcaggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaaggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgcaggtggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggaccaggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgcaggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaaggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgcaggtgactacaaagatgacgacgataaagattacaaagacgatgacgataaggactataaagatgatgacgacaaataataa

SEQ ID NO: 2748 - DNA, 3183 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggaccaggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgcaggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaaggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgcaggtggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggaccaggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgcaggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaaggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgcaggtggttacggtccaggcgctggtcaacaaggtccaggaagtggtggtcaacaaggacctggcggtcaaggaccctacggtagtggccaacaaggtccaggtggagcaggacagcagggtccgggaggccaaggaccttacggaccaggtgctgctgctgccgccgctgccgctgccggaggttacggtccaggagccggacaacagggtccaggtggagctggacaacaaggtccaggatcacaaggtcctggtggacaaggtccatacggtcctggtgctggtcaacagggaccaggtagtcaaggacctggttcaggtggtcagcagggtccaggaggacagggtccttacggcccttctgccgctgcagcagcagccgctgccgcaggaggatacggacctggtgctggacaacgatctcaaggaccaggaggacaaggtccttatggacctggcgctggccaacaaggacctggttctcagggtccaggttcaggaggccaacaaggcccaggaggtcaaggaccatacggaccatccgctgcggcagctgcagctgctgcaggtggatatggcccaggagccggacaacagggtcctggttcacaaggtccaggatctggtggtcaacagggaccaggcggccagggaccttatggtccaggagccgctgcagcagcagcagctgttggaggttacggccctggtgccggtcaacaaggcccaggatctcagggtcctggatctggaggacaacaaggtcctggaggtcagggtccatacggaccttcagcagcagctgctgctgcagccgctggtggttatggacctggtgctggtcaacaaggaccgggttctcagggtccgggttcaggaggtcagcagggccctggtggacaaggaccttatggacctagtgcggctgcagcagctgccgccgcaggtgactacaaagatgacgacgataaagattacaaagacgatgacgataaggactataaagatgatgacgacaaataataa

SEQ ID NO: 2749 - protein, 429 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQRSQGPGGQGPYGPGAGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGDYKDDDDKDYKDDDDKDYKDDDDK

SEQ ID NO: 2750 - protein, 744 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQRSQGPGGQGPYGPGAGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQRSQGPGGQGPYGPGAGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGDYKDDDDKDYKDDDDKDYKDDDDK

SEQ ID NO: 2751 - protein, 1059 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQRSQGPGGQGPYGPGAGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQRSQGPGGQGPYGPGAGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQRSQGPGGQGPYGPGAGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGDYKDDDDKDYKDDDDKDYKDDDDK

SEQ ID NO: 2752 - DNA, 2964 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtggctatggtcctggagccggtcaacaaggaccaggaggagcgggtcagcaaggccccggatcccaaggtccaggtggagctggacaacaaggacctggaggacaaggtccatatggtccaggagctgccgctgccgctgcagccgtcggtggctatggacctggagctggtcaacaaggtcctggttcccagggtcctggctctggaggtcaacaaggccctggaggtcaaggaccatacggaccgtcggcagcagcagccgcagcagccgctggtggatacggaccaggagcaggccaacaaggtccaggttctcaaggaccaggatcgggcggtcagcagggtccaggtggtttaggcccttacggacctagtgcagctgccgcagctgccgctgctggaggctacggccccggagcgggacaacagggtcctggatctcaaggaccaggttcaggaggtcaacagcgacctggtggattgggtccatacggtccttccgctgctgcagcagcagcagcggccggaggatatggccctggagccggacaacaaggtccaggatctcaaggccctggaagcggaggacaacaaagaccaggaggtttgggaccttatggtccatcagctgccgctgcagctgctgcagcaggtggctatggtcctggagccggtcaacaaggaccaggaggagcgggtcagcaaggccccggatcccaaggtccaggtggagctggacaacaaggacctggaggacaaggtccatatggtccaggagctgccgctgccgctgcagccgtcggtggctatggacctggagctggtcaacaaggtcctggttcccagggtcctggctctggaggtcaacaaggccctggaggtcaaggaccatacggaccgtcggcagcagcagccgcagcagccgctggtggatacggaccaggagcaggccaacaaggtccaggttctcaaggaccaggatcgggcggtcagcagggtccaggtggtttaggcccttacggacctagtgcagctgccgcagctgccgctgctggaggctacggccccggagcgggacaacagggtcctggatctcaaggaccaggttcaggaggtcaacagcgacctggtggattgggtccatacggtccttccgctgctgcagcagcagcagcggccggaggatatggccctggagccggacaacaaggtccaggatctcaaggccctggaagcggaggacaacaaagaccaggaggtttgggaccttatggtccatcagctgccgctgcagctgctgcagcaggtggctatggtcctggagccggtcaacaaggaccaggaggagcgggtcagcaaggccccggatcccaaggtccaggtggagctggacaacaaggacctggaggacaaggtccatatggtccaggagctgccgctgccgctgcagccgtcggtggctatggacctggagctggtcaacaaggtcctggttcccagggtcctggctctggaggtcaacaaggccctggaggtcaaggaccatacggaccgtcggcagcagcagccgcagcagccgctggtggatacggaccaggagcaggccaacaaggtccaggttctcaaggaccaggatcgggcggtcagcagggtccaggtggtttaggcccttacggacctagtgcagctgccgcagctgccgctgctggaggctacggccccggagcgggacaacagggtcctggatctcaaggaccaggttcaggaggtcaacagcgacctggtggattgggtccatacggtccttccgctgctgcagcagcagcagcggccggaggatatggccctggagccggacaacaaggtccaggatctcaaggccctggaagcggaggacaacaaagaccaggaggtttgggaccttatggtccatcagctgccgctgcagctgctgcagcaggtggctatggtcctggagccggtcaacaaggaccaggaggagcgggtcagcaaggccccggatcccaaggtccaggtggagctggacaacaaggacctggaggacaaggtccatatggtccaggagctgccgctgccgctgcagccgtcggtggctatggacctggagctggtcaacaaggtcctggttcccagggtcctggctctggaggtcaacaaggccctggaggtcaaggaccatacggaccgtcggcagcagcagccgcagcagccgctggtggatacggaccaggagcaggccaacaaggtccaggttctcaaggaccaggatcgggcggtcagcagggtccaggtggtttaggcccttacggacctagtgcagctgccgcagctgccgctgctggaggctacggccccggagcgggacaacagggtcctggatctcaaggaccaggttcaggaggtcaacagcgacctggtggattgggtccatacggtccttccgctgctgcagcagcagcagcggccggaggatatggccctggagccggacaacaaggtccaggatctcaaggccctggaagcggaggacaacaaagaccaggaggtttgggaccttatggtccatcagctgccgctgcagctgctgcagcaggtgactacaaagatgacgacgataaagattacaaagacgatgacgataaggactataaagatgatgacgacaaataataa

SEQ ID NO: 2753 - DNA, 3684 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtagtgcgccacaaggtgcaggtggtccagcgccacaaggtccttcccagcaaggaccagttagccagggtccatatggaccaggtgctgcagccgctgctgctgctgcaggtggttacggaccaggtgccggacaacaaggcccaggtagccagggaccaggtagtggaggacaacagggtccgggatcacagggaccaggatcaggtggccaacagggtcctggtggacaaggcccatatggtccatcggccgccgccgccgccgcagctgcagctggaggatacggaccaggagccggtcaacagggacctggttcccaaggtccaggttccggtggccaacagggacctggcggacaaggtccttacggtcctggcgcagctgctgctgccgcagctgttggtggttacggacctggtgctggacaacaaggccctggatctcaaggtccaggatccggaggtcaacaaggacctggaggacaaggaccttatggtcctagtgcggcagcagcagctgctgcagccggaggttatggaccaggtgctggtcaacaaggtccaggttcacaaggtcccggttctggtggacaacagggtccaggtggacagggtccatacggaccttcagctgccgcagctgccgctgccgcaggaggttacggtcccggagctggtcagcaaggtcctggatctggaggacagcaaggtccaggtggacaaggaccatacggctccggccagcagggaccaggtggtgcaggacaacagggcccaggcggacaaggaccttacggaccaggtgcagctgcagctgctgctgcagcagcaggtagtgcgccacaaggtgcaggtggtccagcgccacaaggtccttcccagcaaggaccagttagccagggtccatatggaccaggtgctgcagccgctgctgctgctgcaggtggttacggaccaggtgccggacaacaaggcccaggtagccagggaccaggtagtggaggacaacagggtccgggatcacagggaccaggatcaggtggccaacagggtcctggtggacaaggcccatatggtccatcggccgccgccgccgccgcagctgcagctggaggatacggaccaggagccggtcaacagggacctggttcccaaggtccaggttccggtggccaacagggacctggcggacaaggtccttacggtcctggcgcagctgctgctgccgcagctgttggtggttacggacctggtgctggacaacaaggccctggatctcaaggtccaggatccggaggtcaacaaggacctggaggacaaggaccttatggtcctagtgcggcagcagcagctgctgcagccggaggttatggaccaggtgctggtcaacaaggtccaggttcacaaggtcccggttctggtggacaacagggtccaggtggacagggtccatacggaccttcagctgccgcagctgccgctgccgcaggaggttacggtcccggagctggtcagcaaggtcctggatctggaggacagcaaggtccaggtggacaaggaccatacggctccggccagcagggaccaggtggtgcaggacaacagggcccaggcggacaaggaccttacggaccaggtgcagctgcagctgctgctgcagcagcaggtagtgcgccacaaggtgcaggtggtccagcgccacaaggtccttcccagcaaggaccagttagccagggtccatatggaccaggtgctgcagccgctgctgctgctgcaggtggttacggaccaggtgccggacaacaaggcccaggtagccagggaccaggtagtggaggacaacagggtccgggatcacagggaccaggatcaggtggccaacagggtcctggtggacaaggcccatatggtccatcggccgccgccgccgccgcagctgcagctggaggatacggaccaggagccggtcaacagggacctggttcccaaggtccaggttccggtggccaacagggacctggcggacaaggtccttacggtcctggcgcagctgctgctgccgcagctgttggtggttacggacctggtgctggacaacaaggccctggatctcaaggtccaggatccggaggtcaacaaggacctggaggacaaggaccttatggtcctagtgcggcagcagcagctgctgcagccggaggttatggaccaggtgctggtcaacaaggtccaggttcacaaggtcccggttctggtggacaacagggtccaggtggacagggtccatacggaccttcagctgccgcagctgccgctgccgcaggaggttacggtcccggagctggtcagcaaggtcctggatctggaggacagcaaggtccaggtggacaaggaccatacggctccggccagcagggaccaggtggtgcaggacaacagggcccaggcggacaaggaccttacggaccaggtgcagctgcagctgctgctgcagcagcaggtagtgcgccacaaggtgcaggtggtccagcgccacaaggtccttcccagcaaggaccagttagccagggtccatatggaccaggtgctgcagccgctgctgctgctgcaggtggttacggaccaggtgccggacaacaaggcccaggtagccagggaccaggtagtggaggacaacagggtccgggatcacagggaccaggatcaggtggccaacagggtcctggtggacaaggcccatatggtccatcggccgccgccgccgccgcagctgcagctggaggatacggaccaggagccggtcaacagggacctggttcccaaggtccaggttccggtggccaacagggacctggcggacaaggtccttacggtcctggcgcagctgctgctgccgcagctgttggtggttacggacctggtgctggacaacaaggccctggatctcaaggtccaggatccggaggtcaacaaggacctggaggacaaggaccttatggtcctagtgcggcagcagcagctgctgcagccggaggttatggaccaggtgctggtcaacaaggtccaggttcacaaggtcccggttctggtggacaacagggtccaggtggacagggtccatacggaccttcagctgccgcagctgccgctgccgcaggaggttacggtcccggagctggtcagcaaggtcctggatctggaggacagcaaggtccaggtggacaaggaccatacggctccggccagcagggaccaggtggtgcaggacaacagggcccaggcggacaaggaccttacggaccaggtgcagctgcagctgctgctgcagcagcaggtgactacaaagatgacgacgataaagattacaaagacgatgacgataaggactataaagatgatgacgacaaataataa

SEQ ID NO: 2754 - DNA, 3360 bp, Artificial Sequence; identical to SEQ ID NO: 1464
  Description of Artificial Sequence: Synthetic polynucleotide

SEQ ID NO: 2755 - DNA, 3084 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtggatatggacctggcgctggtcagcaaggtcctggatctggaggacagcagggacctggtggacaaggtccatatggcagcggtcaacaaggaccaggtggagcaggtcaacaaggacctggaggtcagggaccttatggccctggtgcagccgcagccgcggccgccgctgctggtggttacggaccaggcgcaggtcaacaaggtcctggcggtgctggacaacagggcccaggttcccagggcccgggtggtcaaggtccatatggtcctggagcaggacaacagggtcctggttctcagggtccaggtagtggcggtcaacaaggtccaggaggccaaggtccttacggcccatcagccgcagcggctgccgctgctgctgccggtggttacggacccggtgctggtcaacgaagtcaaggtccaggaggtcagggtccatacggtccaggtgcaggtcagcagggaccaggatctcaaggtccaggttcaggaggccaacaaggcccaggaggtcagggaccatatggtccatctgctgctgctgctgccgctgccgcaggacctggtgctggtagacaaggtcctggtagccaaggtcctggatccggaggtcagcaaggcccgggcggtcagggtccatatggaccatcggctgctgccgcagctgctgctgcaggtggatatggacctggcgctggtcagcaaggtcctggatctggaggacagcagggacctggtggacaaggtccatatggcagcggtcaacaaggaccaggtggagcaggtcaacaaggacctggaggtcagggaccttatggccctggtgcagccgcagccgcggccgccgctgctggtggttacggaccaggcgcaggtcaacaaggtcctggcggtgctggacaacagggcccaggttcccagggcccgggtggtcaaggtccatatggtcctggagcaggacaacagggtcctggttctcagggtccaggtagtggcggtcaacaaggtccaggaggccaaggtccttacggcccatcagccgcagcggctgccgctgctgctgccggtggttacggacccggtgctggtcaacgaagtcaaggtccaggaggtcagggtccatacggtccaggtgcaggtcagcagggaccaggatctcaaggtccaggttcaggaggccaacaaggcccaggaggtcagggaccatatggtccatctgctgctgctgctgccgctgccgcaggacctggtgctggtagacaaggtcctggtagccaaggtcctggatccggaggtcagcaaggcccgggcggtcagggtccatatggaccatcggctgctgccgcagctgctgctgcaggtggatatggacctggcgctggtcagcaaggtcctggatctggaggacagcagggacctggtggacaaggtccatatggcagcggtcaacaaggaccaggtggagcaggtcaacaaggacctggaggtcagggaccttatggccctggtgcagccgcagccgcggccgccgctgctggtggttacggaccaggcgcaggtcaacaaggtcctggcggtgctggacaacagggcccaggttcccagggcccgggtggtcaaggtccatatggtcctggagcaggacaacagggtcctggttctcagggtccaggtagtggcggtcaacaaggtccaggaggccaaggtccttacggcccatcagccgcagcggctgccgctgctgctgccggtggttacggacccggtgctggtcaacgaagtcaaggtccaggaggtcagggtccatacggtccaggtgcaggtcagcagggaccaggatctcaaggtccaggttcaggaggccaacaaggcccaggaggtcagggaccatatggtccatctgctgctgctgctgccgctgccgcaggacctggtgctggtagacaaggtcctggtagccaaggtcctggatccggaggtcagcaaggcccgggcggtcagggtccatatggaccatcggctgctgccgcagctgctgctgcaggtggatatggacctggcgctggtcagcaaggtcctggatctggaggacagcagggacctggtggacaaggtccatatggcagcggtcaacaaggaccaggtggagcaggtcaacaaggacctggaggtcagggaccttatggccctggtgcagccgcagccgcggccgccgctgctggtggttacggaccaggcgcaggtcaacaaggtcctggcggtgctggacaacagggcccaggttcccagggcccgggtggtcaaggtccatatggtcctggagcaggacaacagggtcctggttctcagggtccaggtagtggcggtcaacaaggtccaggaggccaaggtccttacggcccatcagccgcagcggctgccgctgctgctgccggtggttacggacccggtgctggtcaacgaagtcaaggtccaggaggtcagggtccatacggtccaggtgcaggtcagcagggaccaggatctcaaggtccaggttcaggaggccaacaaggcccaggaggtcagggaccatatggtccatctgctgctgctgctgccgctgccgcaggacctggtgctggtagacaaggtcctggtagccaaggtcctggatccggaggtcagcaaggcccgggcggtcagggtccatatggaccatcggctgctgccgcagctgctgctgcaggtgactacaaagatgacgacgataaagattacaaagacgatgacgataaggactataaagatgatgacgacaaataataa

SEQ ID NO: 2756 - DNA, 3432 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtcctggagcaagaaggcaaggtccaggtagtcagggcccaggttcgggtggtcaacaaggaccaggtggtcagggtccatatggtagtggccagcaaggtccaggtggcgccggtcaacaaggtccaggcggacaaggaccttacggtccaggcgctgccgccgcagcggctgcagccgcaggtggctatggtcctggtgctggccaacaaggaccaggaggagctggccaacagggaccaggaagtcaaggacctggaggacagggaccatatggtccaggagcaggacaacaaggtccgggctcccagggtccgggatctggaggacaacagggccctggaggacaaggtccatatggaccttcggccgccgcagctgcagctgccgcaggaggatatggccctggtgctggacaacagggacctggatcccaaggacctggtagtggaggtcaacaaggcccaggaggacaaggtccttacggtcccggtgcagctgccgctgctgccgctgtaggcggttacggaccaggagcaggtcaacaaggtcctggttctcaaggacctggttcaggaggacaacagggtccaggcggtcaaggcccttatggaccatccgctgctgctgctgcagctgcggcaggtggctacggtcctggtgccggacaacaaggtccaggatctcagggacctggttccggaggacaacaaggaccgggaggacaaggtccgtatggtccttctgctgccgcagccgcggctgctgcaggtcctggagcaagaaggcaaggtccaggtagtcagggcccaggttcgggtggtcaacaaggaccaggtggtcagggtccatatggtagtggccagcaaggtccaggtggcgccggtcaacaaggtccaggcggacaaggaccttacggtccaggcgctgccgccgcagcggctgcagccgcaggtggctatggtcctggtgctggccaacaaggaccaggaggagctggccaacagggaccaggaagtcaaggacctggaggacagggaccatatggtccaggagcaggacaacaaggtccgggctcccagggtccgggatctggaggacaacagggccctggaggacaaggtccatatggaccttcggccgccgcagctgcagctgccgcaggaggatatggccctggtgctggacaacagggacctggatcccaaggacctggtagtggaggtcaacaaggcccaggaggacaaggtccttacggtcccggtgcagctgccgctgctgccgctgtaggcggttacggaccaggagcaggtcaacaaggtcctggttctcaaggacctggttcaggaggacaacagggtccaggcggtcaaggcccttatggaccatccgctgctgctgctgcagctgcggcaggtggctacggtcctggtgccggacaacaaggtccaggatctcagggacctggttccggaggacaacaaggaccgggaggacaaggtccgtatggtccttctgctgccgcagccgcggctgctgcaggtcctggagcaagaaggcaaggtccaggtagtcagggcccaggttcgggtggtcaacaaggaccaggtggtcagggtccatatggtagtggccagcaaggtccaggtggcgccggtcaacaaggtccaggcggacaaggaccttacggtccaggcgctgccgccgcagcggctgcagccgcaggtggctatggtcctggtgctggccaacaaggaccaggaggagctggccaacagggaccaggaagtcaaggacctggaggacagggaccatatggtccaggagcaggacaacaaggtccgggctcccagggtccgggatctggaggacaacagggccctggaggacaaggtccatatggaccttcggccgccgcagctgcagctgccgcaggaggatatggccctggtgctggacaacagggacctggatcccaaggacctggtagtggaggtcaacaaggcccaggaggacaaggtccttacggtcccggtgcagctgccgctgctgccgctgtaggcggttacggaccaggagcaggtcaacaaggtcctggttctcaaggacctggttcaggaggacaacagggtccaggcggtcaaggcccttatggaccatccgctgctgctgctgcagctgcggcaggtggctacggtcctggtgccggacaacaaggtccaggatctcagggacctggttccggaggacaacaaggaccgggaggacaaggtccgtatggtccttctgctgccgcagccgcggctgctgcaggtcctggagcaagaaggcaaggtccaggtagtcagggcccaggttcgggtggtcaacaaggaccaggtggtcagggtccatatggtagtggccagcaaggtccaggtggcgccggtcaacaaggtccaggcggacaaggaccttacggtccaggcgctgccgccgcagcggctgcagccgcaggtggctatggtcctggtgctggccaacaaggaccaggaggagctggccaacagggaccaggaagtcaaggacctggaggacagggaccatatggtccaggagcaggacaacaaggtccgggctcccagggtccgggatctggaggacaacagggccctggaggacaaggtccatatggaccttcggccgccgcagctgcagctgccgcaggaggatatggccctggtgctggacaacagggacctggatcccaaggacctggtagtggaggtcaacaaggcccaggaggacaaggtccttacggtcccggtgcagctgccgctgctgccgctgtaggcggttacggaccaggagcaggtcaacaaggtcctggttctcaaggacctggttcaggaggacaacagggtccaggcggtcaaggcccttatggaccatccgctgctgctgctgcagctgcggcaggtggctacggtcctggtgccggacaacaaggtccaggatctcagggacctggttccggaggacaacaaggaccgggaggacaaggtccgtatggtccttctgctgccgcagccgcggctgctgcaggtgactacaaagatgacgacgataaagattacaaagacgatgacgataaggactataaagatgatgacgacaaataataa

SEQ ID NO: 2757 - DNA, 3408 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtggatacggaccaggtgcaggacaacaaggccctggttccggtggacaacaaggaccaggtggacagggcccttacggctcaggtcagcaaggtccaggaggagcaggtcaacagggtcctggtggtcaaggaccttatggaccaggagctgctgccgcggcagcagcagctgccggaggttacggtccaggtgccggacaacagggtcctggaggtgctggacagcagggtccagagggaccaggttcccaaggtcctggatctggtggtcaacaaggaccaggaggtcagggcccttacggtccaggagctgcagccgctgctgctgcggtcggaggttacggacctggagctggacaacaaggacctggttcacagggacctggaagtggtggtcaacaaggtcctggaggccaaggcccatacggtccatcagctgccgctgccgcagctgctgccggtggttatggtcctggtgctggtcaacaaggtccaggatcgcaaggcccgggatcgggtggacaacagggtccgggaggtcagggaccatatggcccaagtgccgctgcagcagccgccgcagctggtggatatggaccaggagcaggtcaacaaggacctggatccggtggacaacagggaccaggtggacaaggaccatatggatctggtcaacagggaccaggaggtgctggccagcaaggccctggtggtcaaggaccatatggtccaggagcggccgctgctgcggccgctgctgcaggtggatacggaccaggtgcaggacaacaaggccctggttccggtggacaacaaggaccaggtggacagggcccttacggctcaggtcagcaaggtccaggaggagcaggtcaacagggtcctggtggtcaaggaccttatggaccaggagctgctgccgcggcagcagcagctgccggaggttacggtccaggtgccggacaacagggtcctggaggtgctggacagcagggtccagagggaccaggttcccaaggtcctggatctggtggtcaacaaggaccaggaggtcagggcccttacggtccaggagctgcagccgctgctgctgcggtcggaggttacggacctggagctggacaacaaggacctggttcacagggacctggaagtggtggtcaacaaggtcctggaggccaaggcccatacggtccatcagctgccgctgccgcagctgctgccggtggttatggtcctggtgctggtcaacaaggtccaggatcgcaaggcccgggatcgggtggacaacagggtccgggaggtcagggaccatatggcccaagtgccgctgcagcagccgccgcagctggtggatatggaccaggagcaggtcaacaaggacctggatccggtggacaacagggaccaggtggacaaggaccatatggatctggtcaacagggaccaggaggtgctggccagcaaggccctggtggtcaaggaccatatggtccaggagcggccgctgctgcggccgctgctgcaggtggatacggaccaggtgcaggacaacaaggccctggttccggtggacaacaaggaccaggtggacagggcccttacggctcaggtcagcaaggtccaggaggagcaggtcaacagggtcctggtggtcaaggaccttatggaccaggagctgctgccgcggcagcagcagctgccggaggttacggtccaggtgccggacaacagggtcctggaggtgctggacagcagggtccagagggaccaggttcccaaggtcctggatctggtggtcaacaaggaccaggaggtcagggcccttacggtccaggagctgcagccgctgctgctgcggtcggaggttacggacctggagctggacaacaaggacctggttcacagggacctggaagtggtggtcaacaaggtcctggaggccaaggcccatacggtccatcagctgccgctgccgcagctgctgccggtggttatggtcctggtgctggtcaacaaggtccaggatcgcaaggcccgggatcgggtggacaacagggtccgggaggtcagggaccatatggcccaagtgccgctgcagcagccgccgcagctggtggatatggaccaggagcaggtcaacaaggacctggatccggtggacaacagggaccaggtggacaaggaccatatggatctggtcaacagggaccaggaggtgctggccagcaaggccctggtggtcaaggaccatatggtccaggagcggccgctgctgcggccgctgctgcaggtggatacggaccaggtgcaggacaacaaggccctggttccggtggacaacaaggaccaggtggacagggcccttacggctcaggtcagcaaggtccaggaggagcaggtcaacagggtcctggtggtcaaggaccttatggaccaggagctgctgccgcggcagcagcagctgccggaggttacggtccaggtgccggacaacagggtcctggaggtgctggacagcagggtccagagggaccaggttcccaaggtcctggatctggtggtcaacaaggaccaggaggtcagggcccttacggtccaggagctgcagccgctgctgctgcggtcggaggttacggacctggagctggacaacaaggacctggttcacagggacctggaagtggtggtcaacaaggtcctggaggccaaggcccatacggtccatcagctgccgctgccgcagctgctgccggtggttatggtcctggtgctggtcaacaaggtccaggatcgcaaggcccgggatcgggtggacaacagggtccgggaggtcagggaccatatggcccaagtgccgctgcagcagccgccgcagctggtggatatggaccaggagcaggtcaacaaggacctggatccggtggacaacagggaccaggtggacaaggaccatatggatctggtcaacagggaccaggaggtgctggccagcaaggccctggtggtcaaggaccatatggtccaggagcggccgctgctgcggccgctgctgcaggtgactacaaagatgacgacgataaagattacaaagacgatgacgataaggactataaagatgatgacgacaaataataa

SEQ ID NO: 2758 - DNA, 3372 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtggatacggtccgggtgcgggtcaacagggaccaggtggagctggtcaacagggacctggatcacaaggacctggaggtcaaggcccttatggtcccggtgcaggacaacaaggacctggatcgcaaggtcctggatctggaggacagcaaggtcctggtggccaaggcccatacggtccatcagccgcagctgccgcagctgctgccggaggttatggaccaggtgctggtcaacaaggcccgggttcacaaggacctggtagtggtggtcagcaaggaccaggtagtcagggaccaggatcaggtggacaacaaggtccgggtggtcaaggtccatatggaccgtccgctgcggctgcagcagctgctgccgcaggaggttacggacctggcgctggtcaacagggtccaggttcccaaggacctggttctggaggtcaacaaggtccaggtggacagggcccatacggaccaggagcagccgccgccgcagctgctgtgggtggttatggtccaggtgccggacagcaaggaccaggatcccaaggaccaggttctggcggccaacagggtccaggaggccagggcccttatggaccaagtgctgccgcagccgccgcagcagcgggtggttacggtccaggtgccggtcaacaaggaccaggatctcaaggtccaggttccggcggtcaacaaggcccaggaggtcagggtccttatggaccatcggcagctgctgctgctgcagcggcaggtggatacggtccgggtgcgggtcaacagggaccaggtggagctggtcaacagggacctggatcacaaggacctggaggtcaaggcccttatggtcccggtgcaggacaacaaggacctggatcgcaaggtcctggatctggaggacagcaaggtcctggtggccaaggcccatacggtccatcagccgcagctgccgcagctgctgccggaggttatggaccaggtgctggtcaacaaggcccgggttcacaaggacctggtagtggtggtcagcaaggaccaggtagtcagggaccaggatcaggtggacaacaaggtccgggtggtcaaggtccatatggaccgtccgctgcggctgcagcagctgctgccgcaggaggttacggacctggcgctggtcaacagggtccaggttcccaaggacctggttctggaggtcaacaaggtccaggtggacagggcccatacggaccaggagcagccgccgccgcagctgctgtgggtggttatggtccaggtgccggacagcaaggaccaggatcccaaggaccaggttctggcggccaacagggtccaggaggccagggcccttatggaccaagtgctgccgcagccgccgcagcagcgggtggttacggtccaggtgccggtcaacaaggaccaggatctcaaggtccaggttccggcggtcaacaaggcccaggaggtcagggtccttatggaccatcggcagctgctgctgctgcagcggcaggtggatacggtccgggtgcgggtcaacagggaccaggtggagctggtcaacagggacctggatcacaaggacctggaggtcaaggcccttatggtcccggtgcaggacaacaaggacctggatcgcaaggtcctggatctggaggacagcaaggtcctggtggccaaggcccatacggtccatcagccgcagctgccgcagctgctgccggaggttatggaccaggtgctggtcaacaaggcccgggttcacaaggacctggtagtggtggtcagcaaggaccaggtagtcagggaccaggatcaggtggacaacaaggtccgggtggtcaaggtccatatggaccgtccgctgcggctgcagcagctgctgccgcaggaggttacggacctggcgctggtcaacagggtccaggttcccaaggacctggttctggaggtcaacaaggtccaggtggacagggcccatacggaccaggagcagccgccgccgcagctgctgtgggtggttatggtccaggtgccggacagcaaggaccaggatcccaaggaccaggttctggcggccaacagggtccaggaggccagggcccttatggaccaagtgctgccgcagccgccgcagcagcgggtggttacggtccaggtgccggtcaacaaggaccaggatctcaaggtccaggttccggcggtcaacaaggcccaggaggtcagggtccttatggaccatcggcagctgctgctgctgcagcggcaggtggatacggtccgggtgcgggtcaacagggaccaggtggagctggtcaacagggacctggatcacaaggacctggaggtcaaggcccttatggtcccggtgcaggacaacaaggacctggatcgcaaggtcctggatctggaggacagcaaggtcctggtggccaaggcccatacggtccatcagccgcagctgccgcagctgctgccggaggttatggaccaggtgctggtcaacaaggcccgggttcacaaggacctggtagtggtggtcagcaaggaccaggtagtcagggaccaggatcaggtggacaacaaggtccgggtggtcaaggtccatatggaccgtccgctgcggctgcagcagctgctgccgcaggaggttacggacctggcgctggtcaacagggtccaggttcccaaggacctggttctggaggtcaacaaggtccaggtggacagggcccatacggaccaggagcagccgccgccgcagctgctgtgggtggttatggtccaggtgccggacagcaaggaccaggatcccaaggaccaggttctggcggccaacagggtccaggaggccagggcccttatggaccaagtgctgccgcagccgccgcagcagcgggtggttacggtccaggtgccggtcaacaaggaccaggatctcaaggtccaggttccggcggtcaacaaggcccaggaggtcagggtccttatggaccatcggcagctgctgctgctgcagcggcaggtgactacaaagatgacgacgataaagattacaaagacgatgacgataaggactataaagatgatgacgacaaataataa

SEQ ID NO: 2759 - DNA, 3480 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtggttacggtccgggcgctggacaacaaggaccaggttctggtggacaacaaggtcccggtggacaaggtccttacggttcaggccagcaaggtccgggaggagctggtcaacaaggaccaggcggtcaaggtccatacggaccgggagcagcagctgcagcagcagccgctgctggtggatatggtcccggagctggtcaacagggacctggaggagccggacaacaaggacctggtagtcaaggtcctggtggacaaggtccatacggcccaggagcaggtcagcaaggtccgggttctcaaggtcctggctcaggtggacaacaaggcccaggtggacaaggaccatatggtccttctgctgctgccgctgctgcagcagcaggaggatatggaccaggtgctggtcaacagggtccaggttctcagggcccgggttccggaggacagcaaggaccaggcggacaaggcccttacggaccgtcggccgccgctgcggctgctgcagcaggaggatacggtcctggcgcgggtcaacaaggtcctggatctggcggtcagcaaggtccaggaggtcaaggaccatacggttctggtcaacaaggcccaggaggagctggacagcagggccctggaggtcaaggtccttacggtggcggttatggtccaggtgctggacaacagggtcctggatcgcagggaccaggaagtggcggtcaacaaggtccaggtggtcaaggtccttatggtcctagcgccgctgcagctgcagctgcagcaggtggttacggtccgggcgctggacaacaaggaccaggttctggtggacaacaaggtcccggtggacaaggtccttacggttcaggccagcaaggtccgggaggagctggtcaacaaggaccaggcggtcaaggtccatacggaccgggagcagcagctgcagcagcagccgctgctggtggatatggtcccggagctggtcaacagggacctggaggagccggacaacaaggacctggtagtcaaggtcctggtggacaaggtccatacggcccaggagcaggtcagcaaggtccgggttctcaaggtcctggctcaggtggacaacaaggcccaggtggacaaggaccatatggtccttctgctgctgccgctgctgcagcagcaggaggatatggaccaggtgctggtcaacagggtccaggttctcagggcccgggttccggaggacagcaaggaccaggcggacaaggcccttacggaccgtcggccgccgctgcggctgctgcagcaggaggatacggtcctggcgcgggtcaacaaggtcctggatctggcggtcagcaaggtccaggaggtcaaggaccatacggttctggtcaacaaggcccaggaggagctggacagcagggccctggaggtcaaggtccttacggtggcggttatggtccaggtgctggacaacagggtcctggatcgcagggaccaggaagtggcggtcaacaaggtccaggtggtcaaggtccttatggtcctagcgccgctgcagctgcagctgcagcaggtggttacggtccgggcgctggacaacaaggaccaggttctggtggacaacaaggtcccggtggacaaggtccttacggttcaggccagcaaggtccgggaggagctggtcaacaaggaccaggcggtcaaggtccatacggaccgggagcagcagctgcagcagcagccgctgctggtggatatggtcccggagctggtcaacagggacctggaggagccggacaacaaggacctggtagtcaaggtcctggtggacaaggtccatacggcccaggagcaggtcagcaaggtccgggttctcaaggtcctggctcaggtggacaacaaggcccaggtggacaaggaccatatggtccttctgctgctgccgctgctgcagcagcaggaggatatggaccaggtgctggtcaacagggtccaggttctcagggcccgggttccggaggacagcaaggaccaggcggacaaggcccttacggaccgtcggccgccgctgcggctgctgcagcaggaggatacggtcctggcgcgggtcaacaaggtcctggatctggcggtcagcaaggtccaggaggtcaaggaccatacggttctggtcaacaaggcccaggaggagctggacagcagggccctggaggtcaaggtccttacggtggcggttatggtccaggtgctggacaacagggtcctggatcgcagggaccaggaagtggcggtcaacaaggtccaggtggtcaaggtccttatggtcctagcgccgctgcagctgcagctgcagcaggtggttacggtccgggcgctggacaacaaggaccaggttctggtggacaacaaggtcccggtggacaaggtccttacggttcaggccagcaaggtccgggaggagctggtcaacaaggaccaggcggtcaaggtccatacggaccgggagcagcagctgcagcagcagccgctgctggtggatatggtcccggagctggtcaacagggacctggaggagccggacaacaaggacctggtagtcaaggtcctggtggacaaggtccatacggcccaggagcaggtcagcaaggtccgggttctcaaggtcctggctcaggtggacaacaaggcccaggtggacaaggaccatatggtccttctgctgctgccgctgctgcagcagcaggaggatatggaccaggtgctggtcaacagggtccaggttctcagggcccgggttccggaggacagcaaggaccaggcggacaaggcccttacggaccgtcggccgccgctgcggctgctgcagcaggaggatacggtcctggcgcgggtcaacaaggtcctggatctggcggtcagcaaggtccaggaggtcaaggaccatacggttctggtcaacaaggcccaggaggagctggacagcagggccctggaggtcaaggtccttacggtggcggttatggtccaggtgctggacaacagggtcctggatcgcagggaccaggaagtggcggtcaacaaggtccaggtggtcaaggtccttatggtcctagcgccgctgcagctgcagctgcagcaggtgactacaaagatgacgacgataaagattacaaagacgatgacgataaggactataaagatgatgacgacaaataataa

SEQ ID NO: 2760 - DNA, 3444 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtccaggagcccgtagacaaggtccgggctcacaaggtccaggatctggtggacaacaaggaccaggtggccaaggcccatacggatctggacaacagggtcctggtggagctggtcaacagggtccgggcggtcagggcccctacggtccaggagcagcagctgctgcggctgctgcagcaggaggatatggacctggagccggtcaacagggacctggaggtgctggccagcagggtcctggttctcagggaccaggtggtcagggtccatacggcccaggcgccggtcagcaaggaccaggttcacaaggcccaggctctggaggtcagcaaggacccggaggtcaaggtccttatggtccaagtgccgctgctgctgctgctgcagctgcaggaggatacggtccgggagctggtcagcaaggacctggttcgcaaggtcctggtagtggtggccaacaaggtccaggtggtcaaggaccgtacggtccaggagctgcagctgccgccgctgctgtaggaggatacggtccaggtgctggtcaacaaggtcctggaagtcaaggtccaggatccggaggtcagcagggacctggtggacaaggaccttatggtccttctgcagcagctgcagcggctgccgctggtggatatggtcctggagctggacagcagggcccaggatctcagggcccgggttctggaggacaacaaggacctggtggacagggtccatacggaccttccgctgccgccgcggcagctgcagcaggtccaggagcccgtagacaaggtccgggctcacaaggtccaggatctggtggacaacaaggaccaggtggccaaggcccatacggatctggacaacagggtcctggtggagctggtcaacagggtccgggcggtcagggcccctacggtccaggagcagcagctgctgcggctgctgcagcaggaggatatggacctggagccggtcaacagggacctggaggtgctggccagcagggtcctggttctcagggaccaggtggtcagggtccatacggcccaggcgccggtcagcaaggaccaggttcacaaggcccaggctctggaggtcagcaaggacccggaggtcaaggtccttatggtccaagtgccgctgctgctgctgctgcagctgcaggaggatacggtccgggagctggtcagcaaggacctggttcgcaaggtcctggtagtggtggccaacaaggtccaggtggtcaaggaccgtacggtccaggagctgcagctgccgccgctgctgtaggaggatacggtccaggtgctggtcaacaaggtcctggaagtcaaggtccaggatccggaggtcagcagggacctggtggacaaggaccttatggtccttctgcagcagctgcagcggctgccgctggtggatatggtcctggagctggacagcagggcccaggatctcagggcccgggttctggaggacaacaaggacctggtggacagggtccatacggaccttccgctgccgccgcggcagctgcagcaggtccaggagcccgtagacaaggtccgggctcacaaggtccaggatctggtggacaacaaggaccaggtggccaaggcccatacggatctggacaacagggtcctggtggagctggtcaacagggtccgggcggtcagggcccctacggtccaggagcagcagctgctgcggctgctgcagcaggaggatatggacctggagccggtcaacagggacctggaggtgctggccagcagggtcctggttctcagggaccaggtggtcagggtccatacggcccaggcgccggtcagcaaggaccaggttcacaaggcccaggctctggaggtcagcaaggacccggaggtcaaggtccttatggtccaagtgccgctgctgctgctgctgcagctgcaggaggatacggtccgggagctggtcagcaaggacctggttcgcaaggtcctggtagtggtggccaacaaggtccaggtggtcaaggaccgtacggtccaggagctgcagctgccgccgctgctgtaggaggatacggtccaggtgctggtcaacaaggtcctggaagtcaaggtccaggatccggaggtcagcagggacctggtggacaaggaccttatggtccttctgcagcagctgcagcggctgccgctggtggatatggtcctggagctggacagcagggcccaggatctcagggcccgggttctggaggacaacaaggacctggtggacagggtccatacggaccttccgctgccgccgcggcagctgcagcaggtccaggagcccgtagacaaggtccgggctcacaaggtccaggatctggtggacaacaaggaccaggtggccaaggcccatacggatctggacaacagggtcctggtggagctggtcaacagggtccgggcggtcagggcccctacggtccaggagcagcagctgctgcggctgctgcagcaggaggatatggacctggagccggtcaacagggacctggaggtgctggccagcagggtcctggttctcagggaccaggtggtcagggtccatacggcccaggcgccggtcagcaaggaccaggttcacaaggcccaggctctggaggtcagcaaggacccggaggtcaaggtccttatggtccaagtgccgctgctgctgctgctgcagctgcaggaggatacggtccgggagctggtcagcaaggacctggttcgcaaggtcctggtagtggtggccaacaaggtccaggtggtcaaggaccgtacggtccaggagctgcagctgccgccgctgctgtaggaggatacggtccaggtgctggtcaacaaggtcctggaagtcaaggtccaggatccggaggtcagcagggacctggtggacaaggaccttatggtccttctgcagcagctgcagcggctgccgctggtggatatggtcctggagctggacagcagggcccaggatctcagggcccgggttctggaggacaacaaggacctggtggacagggtccatacggaccttccgctgccgccgcggcagctgcagcaggtgactacaaagatgacgacgataaagattacaaagacgatgacgataaggactataaagatgatgacgacaaataataa

SEQ ID NO: 2761 - DNA, 2028 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtccaggttatggaccaggagctggtcagcagggccctggttccggtggacaacaaggtggaccaggctctggccaacagggcccaggtggtgccggtcaaggaggacctagaggtcaaggtccatatggtccaggtgcagctgccgccgccgcagctgcagctggtggatatggaccaggtgctggccagcagggaccaggttctcagggacctggtagcggtggccaacagggaccaggaagtcagggcccatatggacctagtgctgctgcagctgctgctgccgcgggtccgggatatggcccaggagcaggacagcaaggccctggctctcaaggccctggttcaggtggacagcaaggtccaggaggacaaggaccttatggtccatctgcagctgctgccgctgcagcagcaggtccaggttatggaccaggagctggtcagcagggccctggttccggtggacaacaaggtggaccaggctctggccaacagggcccaggtggtgccggtcaaggaggacctagaggtcaaggtccatatggtccaggtgcagctgccgccgccgcagctgcagctggtggatatggaccaggtgctggccagcagggaccaggttctcagggacctggtagcggtggccaacagggaccaggaagtcagggcccatatggacctagtgctgctgcagctgctgctgccgcgggtccgggatatggcccaggagcaggacagcaaggccctggctctcaaggccctggttcaggtggacagcaaggtccaggaggacaaggaccttatggtccatctgcagctgctgccgctgcagcagcaggtccaggttatggaccaggagctggtcagcagggccctggttccggtggacaacaaggtggaccaggctctggccaacagggcccaggtggtgccggtcaaggaggacctagaggtcaaggtccatatggtccaggtgcagctgccgccgccgcagctgcagctggtggatatggaccaggtgctggccagcagggaccaggttctcagggacctggtagcggtggccaacagggaccaggaagtcagggcccatatggacctagtgctgctgcagctgctgctgccgcgggtccgggatatggcccaggagcaggacagcaaggccctggctctcaaggccctggttcaggtggacagcaaggtccaggaggacaaggaccttatggtccatctgcagctgctgccgctgcagcagcaggtccaggttatggaccaggagctggtcagcagggccctggttccggtggacaacaaggtggaccaggctctggccaacagggcccaggtggtgccggtcaaggaggacctagaggtcaaggtccatatggtccaggtgcagctgccgccgccgcagctgcagctggtggatatggaccaggtgctggccagcagggaccaggttctcagggacctggtagcggtggccaacagggaccaggaagtcagggcccatatggacctagtgctgctgcagctgctgctgccgcgggtccgggatatggcccaggagcaggacagcaaggccctggctctcaaggccctggttcaggtggacagcaaggtccaggaggacaaggaccttatggtccatctgcagctgctgccgctgcagcagcaggtgactacaaagatgacgacgataaagattacaaagacgatgacgataaggactataaagatgatgacgacaaataataa

SEQ ID NO: 2762 - DNA, 2028 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtccaggatatggaccaggtgcaggacagcagggaccgggatcaggaggacaacaaggcggtcaaggttcaggtcaacaaggtccaggaggtgctggccagggaggtcctagaggtcaaggaccatatggacctggtgccgctgcggctgccgcagctgcagcaggtggttacggtccaggtgccggacagcaaggcccaggatcacagggtccaggttctggtggtcagcagggtccgggttcgcaaggaccctatggtccatcagccgcagctgctgctgccgcagctggtccaggttacggacctggtgctggccaacaaggaccaggcagtcagggtccaggtagtggtggtcaacaaggcccaggtggtcaaggaccttacggtccatctgctgctgccgctgctgcggcagcaggtccaggatatggaccaggtgcaggacagcagggaccgggatcaggaggacaacaaggcggtcaaggttcaggtcaacaaggtccaggaggtgctggccagggaggtcctagaggtcaaggaccatatggacctggtgccgctgcggctgccgcagctgcagcaggtggttacggtccaggtgccggacagcaaggcccaggatcacagggtccaggttctggtggtcagcagggtccgggttcgcaaggaccctatggtccatcagccgcagctgctgctgccgcagctggtccaggttacggacctggtgctggccaacaaggaccaggcagtcagggtccaggtagtggtggtcaacaaggcccaggtggtcaaggaccttacggtccatctgctgctgccgctgctgcggcagcaggtccaggatatggaccaggtgcaggacagcagggaccgggatcaggaggacaacaaggcggtcaaggttcaggtcaacaaggtccaggaggtgctggccagggaggtcctagaggtcaaggaccatatggacctggtgccgctgcggctgccgcagctgcagcaggtggttacggtccaggtgccggacagcaaggcccaggatcacagggtccaggttctggtggtcagcagggtccgggttcgcaaggaccctatggtccatcagccgcagctgctgctgccgcagctggtccaggttacggacctggtgctggccaacaaggaccaggcagtcagggtccaggtagtggtggtcaacaaggcccaggtggtcaaggaccttacggtccatctgctgctgccgctgctgcggcagcaggtccaggatatggaccaggtgcaggacagcagggaccgggatcaggaggacaacaaggcggtcaaggttcaggtcaacaaggtccaggaggtgctggccagggaggtcctagaggtcaaggaccatatggacctggtgccgctgcggctgccgcagctgcagcaggtggttacggtccaggtgccggacagcaaggcccaggatcacagggtccaggttctggtggtcagcagggtccgggttcgcaaggaccctatggtccatcagccgcagctgctgctgccgcagctggtccaggttacggacctggtgctggccaacaaggaccaggcagtcagggtccaggtagtggtggtcaacaaggcccaggtggtcaaggaccttacggtccatctgctgctgccgctgctgcggcagcaggtgactacaaagatgacgacgataaagattacaaagacgatgacgataaggactataaagatgatgacgacaaataataa

SEQ ID NO: 2763 - DNA, 2016 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtcctggttatggacccggtgccggacaacaaggaccgggttcaggtggccagcaaggaggtcaaggttcaggacaacaaggtcctggtggtgctggacagggaggacctagaggtcaaggaccctacggtccaggagcagcagctgcggccgctgctgctggaggatacggtccaggtgcaggacagcaaggacctggctcacagggaccaggcagtggaggacaacagggacctggctctcaaggtccgtatggtccaagtgctgccgcggcagcggctgctgccggtccaggttacggccctggtgcaggtcaacagggcccaggttcacaaggtcctggttctggtggacagcagggtccaggttctcaaggaccttatggtccatctgccgcagctgccgcagctgctgcaggtcctggttatggacccggtgccggacaacaaggaccgggttcaggtggccagcaaggaggtcaaggttcaggacaacaaggtcctggtggtgctggacagggaggacctagaggtcaaggaccctacggtccaggagcagcagctgcggccgctgctgctggaggatacggtccaggtgcaggacagcaaggacctggctcacagggaccaggcagtggaggacaacagggacctggctctcaaggtccgtatggtccaagtgctgccgcggcagcggctgctgccggtccaggttacggccctggtgcaggtcaacagggcccaggttcacaaggtcctggttctggtggacagcagggtccaggttctcaaggaccttatggtccatctgccgcagctgccgcagctgctgcaggtcctggttatggacccggtgccggacaacaaggaccgggttcaggtggccagcaaggaggtcaaggttcaggacaacaaggtcctggtggtgctggacagggaggacctagaggtcaaggaccctacggtccaggagcagcagctgcggccgctgctgctggaggatacggtccaggtgcaggacagcaaggacctggctcacagggaccaggcagtggaggacaacagggacctggctctcaaggtccgtatggtccaagtgctgccgcggcagcggctgctgccggtccaggttacggccctggtgcaggtcaacagggcccaggttcacaaggtcctggttctggtggacagcagggtccaggttctcaaggaccttatggtccatctgccgcagctgccgcagctgctgcaggtcctggttatggacccggtgccggacaacaaggaccgggttcaggtggccagcaaggaggtcaaggttcaggacaacaaggtcctggtggtgctggacagggaggacctagaggtcaaggaccctacggtccaggagcagcagctgcggccgctgctgctggaggatacggtccaggtgcaggacagcaaggacctggctcacagggaccaggcagtggaggacaacagggacctggctctcaaggtccgtatggtccaagtgctgccgcggcagcggctgctgccggtccaggttacggccctggtgcaggtcaacagggcccaggttcacaaggtcctggttctggtggacagcagggtccaggttctcaaggaccttatggtccatctgccgcagctgccgcagctgctgcaggtgactacaaagatgacgacgataaagattacaaagacgatgacgataaggactataaagatgatgacgacaaataataa

SEQ ID NO: 2764 - DNA, 3180 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtcctggaggttacggtggaccaggacagcagggtcctggtcaaggacaacaacaaggacctgcttcagctgccgcggccgctgctgccgctggacctggaggatatggtggacctggtcagcaaggacctggacaaggtcaacagcagggtcctgcaagcgctgccgcagcggctgccgccgctgcgggtcctggtggatacggaggacctggacagcagcgtcccggacaggctcaatacggtagaggtaccggtcaacaaggtcaaggtccaggtgctcaacaaggtccagctagtgcagctgccgcagctgcagctggagctggattatacggcggaccaggtcaacaaggccctggtcaaggtcagcaacaaggacccgcatcagcagcagctgccgctgccgctgctgccgcagctggaccaggcggatatggtggtccgggtcaacagggtccaggacaagcccaacagcaaggaccagcctctgctgctgctgccgctgctgctggcccaggaggctactccggaccaggacagcaaggtcctggacaggctcaacaacagggtccagcttcagccgctgccgccgccgccgctgccgctggtccaggtggttacggtggtcctggccaacagggtccaggtcaaggccaacaacagggacctgcttccgctgctgctgctgcagccgctaccgcagcaggtcctggaggttacggtggaccaggacagcagggtcctggtcaaggacaacaacaaggacctgcttcagctgccgcggccgctgctgccgctggacctggaggatatggtggacctggtcagcaaggacctggacaaggtcaacagcagggtcctgcaagcgctgccgcagcggctgccgccgctgcgggtcctggtggatacggaggacctggacagcagcgtcccggacaggctcaatacggtagaggtaccggtcaacaaggtcaaggtccaggtgctcaacaaggtccagctagtgcagctgccgcagctgcagctggagctggattatacggcggaccaggtcaacaaggccctggtcaaggtcagcaacaaggacccgcatcagcagcagctgccgctgccgctgctgccgcagctggaccaggcggatatggtggtccgggtcaacagggtccaggacaagcccaacagcaaggaccagcctctgctgctgctgccgctgctgctggcccaggaggctactccggaccaggacagcaaggtcctggacaggctcaacaacagggtccagcttcagccgctgccgccgccgccgctgccgctggtccaggtggttacggtggtcctggccaacagggtccaggtcaaggccaacaacagggacctgcttccgctgctgctgctgcagccgctaccgcagcaggtcctggaggttacggtggaccaggacagcagggtcctggtcaaggacaacaacaaggacctgcttcagctgccgcggccgctgctgccgctggacctggaggatatggtggacctggtcagcaaggacctggacaaggtcaacagcagggtcctgcaagcgctgccgcagcggctgccgccgctgcgggtcctggtggatacggaggacctggacagcagcgtcccggacaggctcaatacggtagaggtaccggtcaacaaggtcaaggtccaggtgctcaacaaggtccagctagtgcagctgccgcagctgcagctggagctggattatacggcggaccaggtcaacaaggccctggtcaaggtcagcaacaaggacccgcatcagcagcagctgccgctgccgctgctgccgcagctggaccaggcggatatggtggtccgggtcaacagggtccaggacaagcccaacagcaaggaccagcctctgctgctgctgccgctgctgctggcccaggaggctactccggaccaggacagcaaggtcctggacaggctcaacaacagggtccagcttcagccgctgccgccgccgccgctgccgctggtccaggtggttacggtggtcctggccaacagggtccaggtcaaggccaacaacagggacctgcttccgctgctgctgctgcagccgctaccgcagcaggtcctggaggttacggtggaccaggacagcagggtcctggtcaaggacaacaacaaggacctgcttcagctgccgcggccgctgctgccgctggacctggaggatatggtggacctggtcagcaaggacctggacaaggtcaacagcagggtcctgcaagcgctgccgcagcggctgccgccgctgcgggtcctggtggatacggaggacctggacagcagcgtcccggacaggctcaatacggtagaggtaccggtcaacaaggtcaaggtccaggtgctcaacaaggtccagctagtgcagctgccgcagctgcagctggagctggattatacggcggaccaggtcaacaaggccctggtcaaggtcagcaacaaggacccgcatcagcagcagctgccgctgccgctgctgccgcagctggaccaggcggatatggtggtccgggtcaacagggtccaggacaagcccaacagcaaggaccagcctctgctgctgctgccgctgctgctggcccaggaggctactccggaccaggacagcaaggtcctggacaggctcaacaacagggtccagcttcagccgctgccgccgccgccgctgccgctggtccaggtggttacggtggtcctggccaacagggtccaggtcaaggccaacaacagggacctgcttccgctgctgctgctgcagccgctaccgcagcaggtgactacaaagatgacgacgataaagattacaaagacgatgacgataaggactataaagatgatgacgacaaataataa

SEQ ID NO: 2765 - DNA, 3084 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtccaggaggatacggtggtccaggtcaacagggacccggacagggtcaatatggtccaggtactggtcagcaaggacaaggaccgtctggacaacagggaccagcaggcgctgccgcagcagcagccgctgcggcaggtcctggaggttatggtggtccaggtcagcagggtccaggtcaaggacaatacggacctggtgctggacaacaaggccaaggtcctggtggccaacagggtccggcgggtgctgctgctgcagccgctgctgctgcaggacccggtggttatggaggtccaggtcaacaaggacctggccaaggacaacaacaaggtagggcaggagcagcggctgcggccgctgctggaccaggaggctacggaggtccaggacagcaaggtcctggtcaagcacagcaacaaggaccggcagcagccgctagtgctggacctggtggttacggtggtcctggtcaacaaggacccggtcaaggtcaacagaagggacctgcatcagctgcagctgcagctgctgccacagcagccggtccaggaggatatggcggtcctggtcaacagggtcctggtcaaggccagtacggccctggtaccggtcaacagggtcaaggtccaggtggtcaacaaggtcctgcatcagctgccgccgctgcagctgctgctgcaggtccaggaggatacggtggtccaggtcaacagggacccggacagggtcaatatggtccaggtactggtcagcaaggacaaggaccgtctggacaacagggaccagcaggcgctgccgcagcagcagccgctgcggcaggtcctggaggttatggtggtccaggtcagcagggtccaggtcaaggacaatacggacctggtgctggacaacaaggccaaggtcctggtggccaacagggtccggcgggtgctgctgctgcagccgctgctgctgcaggacccggtggttatggaggtccaggtcaacaaggacctggccaaggacaacaacaaggtagggcaggagcagcggctgcggccgctgctggaccaggaggctacggaggtccaggacagcaaggtcctggtcaagcacagcaacaaggaccggcagcagccgctagtgctggacctggtggttacggtggtcctggtcaacaaggacccggtcaaggtcaacagaagggacctgcatcagctgcagctgcagctgctgccacagcagccggtccaggaggatatggcggtcctggtcaacagggtcctggtcaaggccagtacggccctggtaccggtcaacagggtcaaggtccaggtggtcaacaaggtcctgcatcagctgccgccgctgcagctgctgctgcaggtccaggaggatacggtggtccaggtcaacagggacccggacagggtcaatatggtccaggtactggtcagcaaggacaaggaccgtctggacaacagggaccagcaggcgctgccgcagcagcagccgctgcggcaggtcctggaggttatggtggtccaggtcagcagggtccaggtcaaggacaatacggacctggtgctggacaacaaggccaaggtcctggtggccaacagggtccggcgggtgctgctgctgcagccgctgctgctgcaggacccggtggttatggaggtccaggtcaacaaggacctggccaaggacaacaacaaggtagggcaggagcagcggctgcggccgctgctggaccaggaggctacggaggtccaggacagcaaggtcctggtcaagcacagcaacaaggaccggcagcagccgctagtgctggacctggtggttacggtggtcctggtcaacaaggacccggtcaaggtcaacagaagggacctgcatcagctgcagctgcagctgctgccacagcagccggtccaggaggatatggcggtcctggtcaacagggtcctggtcaaggccagtacggccctggtaccggtcaacagggtcaaggtccaggtggtcaacaaggtcctgcatcagctgccgccgctgcagctgctgctgcaggtccaggaggatacggtggtccaggtcaacagggacccggacagggtcaatatggtccaggtactggtcagcaaggacaaggaccgtctggacaacagggaccagcaggcgctgccgcagcagcagccgctgcggcaggtcctggaggttatggtggtccaggtcagcagggtccaggtcaaggacaatacggacctggtgctggacaacaaggccaaggtcctggtggccaacagggtccggcgggtgctgctgctgcagccgctgctgctgcaggacccggtggttatggaggtccaggtcaacaaggacctggccaaggacaacaacaaggtagggcaggagcagcggctgcggccgctgctggaccaggaggctacggaggtccaggacagcaaggtcctggtcaagcacagcaacaaggaccggcagcagccgctagtgctggacctggtggttacggtggtcctggtcaacaaggacccggtcaaggtcaacagaagggacctgcatcagctgcagctgcagctgctgccacagcagccggtccaggaggatatggcggtcctggtcaacagggtcctggtcaaggccagtacggccctggtaccggtcaacagggtcaaggtccaggtggtcaacaaggtcctgcatcagctgccgccgctgcagctgctgctgcaggtgactacaaagatgacgacgataaagattacaaagacgatgacgataaggactataaagatgatgacgacaaataataa

SEQ ID NO: 2766 - DNA, 3276 bp, Artificial Sequence; identical to SEQ ID NO: 1468
  Description of Artificial Sequence: Synthetic polynucleotide

SEQ ID NO: 2767 - DNA, 3096 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtccaggaggatacggaggaccaggtcaacaaggtccgggtcaaggccagtatggaccaggaactggacaacaaggacaaggaccaggtggacagcagggaccagttggagctgctgcggctgcagctgcggctgtgtctagtggtggttatggttcccagggtgctggtcagggtggccaacaaggctctggacagagaggtccagctgccgctggaccaggcggttattccggtccgggtcaacagggccccggacaaggtggccaacaaggaccagcatccgccgctgctgcagctgctgccgctgcaggtcctggtggatatggtggttccggccagcagggtcctggacaaggacgaggaactggtcaacagggtcaaggtccaggcggtcaacaaggtcctgcttcggcggccgccgcagctgccgccggacctggaggatatggaggtcccggtcaacaaggcccaggtcaaggtcaatatggacctggtactggacagcagggccaaggtcccgcttctgctgctgctgcagccgccgctggacctggtggatatggcggaccaggtcagcaaggtcctggtcagggtcaatacggtccaggtactggacagcaaggccaaggtccaggtggtcagcaaggaccgggaggagcaagtgctgctgcagctgcagcagcaggtccaggaggatacggaggaccaggtcaacaaggtccgggtcaaggccagtatggaccaggaactggacaacaaggacaaggaccaggtggacagcagggaccagttggagctgctgcggctgcagctgcggctgtgtctagtggtggttatggttcccagggtgctggtcagggtggccaacaaggctctggacagagaggtccagctgccgctggaccaggcggttattccggtccgggtcaacagggccccggacaaggtggccaacaaggaccagcatccgccgctgctgcagctgctgccgctgcaggtcctggtggatatggtggttccggccagcagggtcctggacaaggacgaggaactggtcaacagggtcaaggtccaggcggtcaacaaggtcctgcttcggcggccgccgcagctgccgccggacctggaggatatggaggtcccggtcaacaaggcccaggtcaaggtcaatatggacctggtactggacagcagggccaaggtcccgcttctgctgctgctgcagccgccgctggacctggtggatatggcggaccaggtcagcaaggtcctggtcagggtcaatacggtccaggtactggacagcaaggccaaggtccaggtggtcagcaaggaccgggaggagcaagtgctgctgcagctgcagcagcaggtccaggaggatacggaggaccaggtcaacaaggtccgggtcaaggccagtatggaccaggaactggacaacaaggacaaggaccaggtggacagcagggaccagttggagctgctgcggctgcagctgcggctgtgtctagtggtggttatggttcccagggtgctggtcagggtggccaacaaggctctggacagagaggtccagctgccgctggaccaggcggttattccggtccgggtcaacagggccccggacaaggtggccaacaaggaccagcatccgccgctgctgcagctgctgccgctgcaggtcctggtggatatggtggttccggccagcagggtcctggacaaggacgaggaactggtcaacagggtcaaggtccaggcggtcaacaaggtcctgcttcggcggccgccgcagctgccgccggacctggaggatatggaggtcccggtcaacaaggcccaggtcaaggtcaatatggacctggtactggacagcagggccaaggtcccgcttctgctgctgctgcagccgccgctggacctggtggatatggcggaccaggtcagcaaggtcctggtcagggtcaatacggtccaggtactggacagcaaggccaaggtccaggtggtcagcaaggaccgggaggagcaagtgctgctgcagctgcagcagcaggtccaggaggatacggaggaccaggtcaacaaggtccgggtcaaggccagtatggaccaggaactggacaacaaggacaaggaccaggtggacagcagggaccagttggagctgctgcggctgcagctgcggctgtgtctagtggtggttatggttcccagggtgctggtcagggtggccaacaaggctctggacagagaggtccagctgccgctggaccaggcggttattccggtccgggtcaacagggccccggacaaggtggccaacaaggaccagcatccgccgctgctgcagctgctgccgctgcaggtcctggtggatatggtggttccggccagcagggtcctggacaaggacgaggaactggtcaacagggtcaaggtccaggcggtcaacaaggtcctgcttcggcggccgccgcagctgccgccggacctggaggatatggaggtcccggtcaacaaggcccaggtcaaggtcaatatggacctggtactggacagcagggccaaggtcccgcttctgctgctgctgcagccgccgctggacctggtggatatggcggaccaggtcagcaaggtcctggtcagggtcaatacggtccaggtactggacagcaaggccaaggtccaggtggtcagcaaggaccgggaggagcaagtgctgctgcagctgcagcagcaggtgactacaaagatgacgacgataaagattacaaagacgatgacgataaggactataaagatgatgacgacaaataataa

SEQ ID NO: 2768 - DNA, 2940 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtcccggtggctatggacctggtcaacagggtcctggaggttatggtcccggtcaacaaggacctggaagatacggtccaggtcaacaaggaccatcaggtccaggaagtgcagccgcggctgctgctggttccggacaacagggacctggcggctacggaccacgtcaacagggtcccggtggttatggtcaaggccaacaaggtccatctggtccaggctcagctgcagcagcatctgctgcagccagcgctgagtcaggtcaacaaggtcccggtggatatggtccaggacaacaaggccctggtggatatggaccaggtcaacagggtccaggcggatacggccctggccagcaaggaccgtccggaccaggttctgcggccgctgcggctgcagctgcctcaggtcctggtcagcaaggtccaggaggctatggtcctggacagcaaggtccgggaggatatggacctggacaacaaggaccttctggacctggctctgctgcagcggctgctgccgcggcgtcgggtccaggacaacagggccctggaggatacggtccaggacagcaaggtccaggtggttatggtcctggtcagcagggactgtctggtcctggatctgctgctgctgcagcagctgcaggtcccggtggctatggacctggtcaacagggtcctggaggttatggtcccggtcaacaaggacctggaagatacggtccaggtcaacaaggaccatcaggtccaggaagtgcagccgcggctgctgctggttccggacaacagggacctggcggctacggaccacgtcaacagggtcccggtggttatggtcaaggccaacaaggtccatctggtccaggctcagctgcagcagcatctgctgcagccagcgctgagtcaggtcaacaaggtcccggtggatatggtccaggacaacaaggccctggtggatatggaccaggtcaacagggtccaggcggatacggccctggccagcaaggaccgtccggaccaggttctgcggccgctgcggctgcagctgcctcaggtcctggtcagcaaggtccaggaggctatggtcctggacagcaaggtccgggaggatatggacctggacaacaaggaccttctggacctggctctgctgcagcggctgctgccgcggcgtcgggtccaggacaacagggccctggaggatacggtccaggacagcaaggtccaggtggttatggtcctggtcagcagggactgtctggtcctggatctgctgctgctgcagcagctgcaggtcccggtggctatggacctggtcaacagggtcctggaggttatggtcccggtcaacaaggacctggaagatacggtccaggtcaacaaggaccatcaggtccaggaagtgcagccgcggctgctgctggttccggacaacagggacctggcggctacggaccacgtcaacagggtcccggtggttatggtcaaggccaacaaggtccatctggtccaggctcagctgcagcagcatctgctgcagccagcgctgagtcaggtcaacaaggtcccggtggatatggtccaggacaacaaggccctggtggatatggaccaggtcaacagggtccaggcggatacggccctggccagcaaggaccgtccggaccaggttctgcggccgctgcggctgcagctgcctcaggtcctggtcagcaaggtccaggaggctatggtcctggacagcaaggtccgggaggatatggacctggacaacaaggaccttctggacctggctctgctgcagcggctgctgccgcggcgtcgggtccaggacaacagggccctggaggatacggtccaggacagcaaggtccaggtggttatggtcctggtcagcagggactgtctggtcctggatctgctgctgctgcagcagctgcaggtcccggtggctatggacctggtcaacagggtcctggaggttatggtcccggtcaacaaggacctggaagatacggtccaggtcaacaaggaccatcaggtccaggaagtgcagccgcggctgctgctggttccggacaacagggacctggcggctacggaccacgtcaacagggtcccggtggttatggtcaaggccaacaaggtccatctggtccaggctcagctgcagcagcatctgctgcagccagcgctgagtcaggtcaacaaggtcccggtggatatggtccaggacaacaaggccctggtggatatggaccaggtcaacagggtccaggcggatacggccctggccagcaaggaccgtccggaccaggttctgcggccgctgcggctgcagctgcctcaggtcctggtcagcaaggtccaggaggctatggtcctggacagcaaggtccgggaggatatggacctggacaacaaggaccttctggacctggctctgctgcagcggctgctgccgcggcgtcgggtccaggacaacagggccctggaggatacggtccaggacagcaaggtccaggtggttatggtcctggtcagcagggactgtctggtcctggatctgctgctgctgcagcagctgcaggtgactacaaagatgacgacgataaagattacaaagacgatgacgataaggactataaagatgatgacgacaaataataa

SEQ ID NO: 2769 - DNA, 3048 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtagaggaccaggaggttatggtccaggtcagcagggaccgggtggacctggagcagctgcagcggctgccggtcccggaggttatggaccaggtggttacggtccaggtcaacaaggtcctggtggtccaggagccgctgccgctgctgccgccggccgcggtccaggtggttatggtccaggacaacaaggtcctggccaacaaggcccaggtggttccggtgctgcagctgcagctgcgggaagaggtccaggtggatacggaccgggtcaacaaggccctggtggaccaggtgccgccgccgctgctgctggtccaggtggatatggtcctggtcagcagggacctggtgctgctgcagcagccgccgcagctggtagaggtcccggtggatatggtccgggccagcagggaccaggaggccctggtgccgcagctgctgctgccgctggacgtggaccgggtggatacggtcctggtcagcaaggaccaggtcaacagggtccaggcggttccggtgcagctgccgctgccgctggaagaggaccaggcggatatggtcctggacaacaaggacctggaggacctggtgccgccgcagcagctgcaggtcctggaggatatggacctggtcaacaaggaccaggagcagcagcagccgccgccgctgcaggtagaggaccaggaggttatggtccaggtcagcagggaccgggtggacctggagcagctgcagcggctgccggtcccggaggttatggaccaggtggttacggtccaggtcaacaaggtcctggtggtccaggagccgctgccgctgctgccgccggccgcggtccaggtggttatggtccaggacaacaaggtcctggccaacaaggcccaggtggttccggtgctgcagctgcagctgcgggaagaggtccaggtggatacggaccgggtcaacaaggccctggtggaccaggtgccgccgccgctgctgctggtccaggtggatatggtcctggtcagcagggacctggtgctgctgcagcagccgccgcagctggtagaggtcccggtggatatggtccgggccagcagggaccaggaggccctggtgccgcagctgctgctgccgctggacgtggaccgggtggatacggtcctggtcagcaaggaccaggtcaacagggtccaggcggttccggtgcagctgccgctgccgctggaagaggaccaggcggatatggtcctggacaacaaggacctggaggacctggtgccgccgcagcagctgcaggtcctggaggatatggacctggtcaacaaggaccaggagcagcagcagccgccgccgctgcaggtagaggaccaggaggttatggtccaggtcagcagggaccgggtggacctggagcagctgcagcggctgccggtcccggaggttatggaccaggtggttacggtccaggtcaacaaggtcctggtggtccaggagccgctgccgctgctgccgccggccgcggtccaggtggttatggtccaggacaacaaggtcctggccaacaaggcccaggtggttccggtgctgcagctgcagctgcgggaagaggtccaggtggatacggaccgggtcaacaaggccctggtggaccaggtgccgccgccgctgctgctggtccaggtggatatggtcctggtcagcagggacctggtgctgctgcagcagccgccgcagctggtagaggtcccggtggatatggtccgggccagcagggaccaggaggccctggtgccgcagctgctgctgccgctggacgtggaccgggtggatacggtcctggtcagcaaggaccaggtcaacagggtccaggcggttccggtgcagctgccgctgccgctggaagaggaccaggcggatatggtcctggacaacaaggacctggaggacctggtgccgccgcagcagctgcaggtcctggaggatatggacctggtcaacaaggaccaggagcagcagcagccgccgccgctgcaggtagaggaccaggaggttatggtccaggtcagcagggaccgggtggacctggagcagctgcagcggctgccggtcccggaggttatggaccaggtggttacggtccaggtcaacaaggtcctggtggtccaggagccgctgccgctgctgccgccggccgcggtccaggtggttatggtccaggacaacaaggtcctggccaacaaggcccaggtggttccggtgctgcagctgcagctgcgggaagaggtccaggtggatacggaccgggtcaacaaggccctggtggaccaggtgccgccgccgctgctgctggtccaggtggatatggtcctggtcagcagggacctggtgctgctgcagcagccgccgcagctggtagaggtcccggtggatatggtccgggccagcagggaccaggaggccctggtgccgcagctgctgctgccgctggacgtggaccgggtggatacggtcctggtcagcaaggaccaggtcaacagggtccaggcggttccggtgcagctgccgctgccgctggaagaggaccaggcggatatggtcctggacaacaaggacctggaggacctggtgccgccgcagcagctgcaggtcctggaggatatggacctggtcaacaaggaccaggagcagcagcagccgccgccgctgcaggtgactacaaagatgacgacgataaagattacaaagacgatgacgataaggactataaagatgatgacgacaaataataa

SEQ ID NO: 2770 - DNA, 3048 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtcgtggtccgggaggatacggtccaggacagcaaggtccgggtggatctggcgccgcagcagctgctgctggaagaggtccaggaggttatggtccaggacagcagggaccaggtggtccaggagcagctgcagccgctgctggtcctggtggttacggtccaggacaacaaggcacgggtgctgcggctgccgcagcagctggttctggtgccggaggttacggtcctggacagcagggcccaggtggtcctggtgctgccgcagcagcagctggacctggaggatacggccccggacagcaaggcccaggtgcagcagccgctgccgctgctggaagtggtccaggcggatatggtccaggtcaacaaggtcctggtggttcttctgctgccgccgcagccgcaggtccaggtagatacggaccgggtcagcaaggtccaggtgcagccgctgctgcttctgctggccgtggtccaggaggttacggtccgggccaacaaggtccaggcggtcctggtgccgctgctgcagctgccggtcctggaggttatggccctggtcaacaaggccctggagccgctgctgccgctgctgcaggatcaggtccaggcggatacggacctggtcagcaaggtcccggaggtccaggagctgcagctgccgcagctgcaggtcgtggtccgggaggatacggtccaggacagcaaggtccgggtggatctggcgccgcagcagctgctgctggaagaggtccaggaggttatggtccaggacagcagggaccaggtggtccaggagcagctgcagccgctgctggtcctggtggttacggtccaggacaacaaggcacgggtgctgcggctgccgcagcagctggttctggtgccggaggttacggtcctggacagcagggcccaggtggtcctggtgctgccgcagcagcagctggacctggaggatacggccccggacagcaaggcccaggtgcagcagccgctgccgctgctggaagtggtccaggcggatatggtccaggtcaacaaggtcctggtggttcttctgctgccgccgcagccgcaggtccaggtagatacggaccgggtcagcaaggtccaggtgcagccgctgctgcttctgctggccgtggtccaggaggttacggtccgggccaacaaggtccaggcggtcctggtgccgctgctgcagctgccggtcctggaggttatggccctggtcaacaaggccctggagccgctgctgccgctgctgcaggatcaggtccaggcggatacggacctggtcagcaaggtcccggaggtccaggagctgcagctgccgcagctgcaggtcgtggtccgggaggatacggtccaggacagcaaggtccgggtggatctggcgccgcagcagctgctgctggaagaggtccaggaggttatggtccaggacagcagggaccaggtggtccaggagcagctgcagccgctgctggtcctggtggttacggtccaggacaacaaggcacgggtgctgcggctgccgcagcagctggttctggtgccggaggttacggtcctggacagcagggcccaggtggtcctggtgctgccgcagcagcagctggacctggaggatacggccccggacagcaaggcccaggtgcagcagccgctgccgctgctggaagtggtccaggcggatatggtccaggtcaacaaggtcctggtggttcttctgctgccgccgcagccgcaggtccaggtagatacggaccgggtcagcaaggtccaggtgcagccgctgctgcttctgctggccgtggtccaggaggttacggtccgggccaacaaggtccaggcggtcctggtgccgctgctgcagctgccggtcctggaggttatggccctggtcaacaaggccctggagccgctgctgccgctgctgcaggatcaggtccaggcggatacggacctggtcagcaaggtcccggaggtccaggagctgcagctgccgcagctgcaggtcgtggtccgggaggatacggtccaggacagcaaggtccgggtggatctggcgccgcagcagctgctgctggaagaggtccaggaggttatggtccaggacagcagggaccaggtggtccaggagcagctgcagccgctgctggtcctggtggttacggtccaggacaacaaggcacgggtgctgcggctgccgcagcagctggttctggtgccggaggttacggtcctggacagcagggcccaggtggtcctggtgctgccgcagcagcagctggacctggaggatacggccccggacagcaaggcccaggtgcagcagccgctgccgctgctggaagtggtccaggcggatatggtccaggtcaacaaggtcctggtggttcttctgctgccgccgcagccgcaggtccaggtagatacggaccgggtcagcaaggtccaggtgcagccgctgctgcttctgctggccgtggtccaggaggttacggtccgggccaacaaggtccaggcggtcctggtgccgctgctgcagctgccggtcctggaggttatggccctggtcaacaaggccctggagccgctgctgccgctgctgcaggatcaggtccaggcggatacggacctggtcagcaaggtcccggaggtccaggagctgcagctgccgcagctgcaggtgactacaaagatgacgacgataaagattacaaagacgatgacgataaggactataaagatgatgacgacaaataataa

SEQ ID NO: 2771 - DNA, 2940 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtcgtggtcctggtggctatggacaaggtcagcaaggacccggcggacctggcgcagcagctgccgcggccggtccaggtggttatggacctggacaacaaggacctggagcagcagcagctgcagccgctggatctggccctggtggatatggacctggtcagcaaggaccaggacgttcaggtgcagctgctgcagcagccgcagctggtcgtggtccaggtggatatggtccaggacagcagggcccaggaggccctggtgccgcagcggccgctgccggtcctggtggttatggtccaggccaacaaggtcctggtgcagctgcagcagctagtgctggtcgaggacctggtggatatggtcctggacaacaaggtccgggtggatccggagccgctgctgctgcagccggtagaggtcccggtggatacggtccgggtcaacaaggtccaggtggtcctggagctgctgctgcagctgccgctggccgtggtccaggtggctacggaccaggtcaacaaggccctggtcagcagggtcctggaggaagcggtgctgcggctgccgccgctggtcgtggccctggcggatacggtccaggtcaacagggaccaggtggtccaggtgctgctgctgctgccgcaggtcgtggtcctggtggctatggacaaggtcagcaaggacccggcggacctggcgcagcagctgccgcggccggtccaggtggttatggacctggacaacaaggacctggagcagcagcagctgcagccgctggatctggccctggtggatatggacctggtcagcaaggaccaggacgttcaggtgcagctgctgcagcagccgcagctggtcgtggtccaggtggatatggtccaggacagcagggcccaggaggccctggtgccgcagcggccgctgccggtcctggtggttatggtccaggccaacaaggtcctggtgcagctgcagcagctagtgctggtcgaggacctggtggatatggtcctggacaacaaggtccgggtggatccggagccgctgctgctgcagccggtagaggtcccggtggatacggtccgggtcaacaaggtccaggtggtcctggagctgctgctgcagctgccgctggccgtggtccaggtggctacggaccaggtcaacaaggccctggtcagcagggtcctggaggaagcggtgctgcggctgccgccgctggtcgtggccctggcggatacggtccaggtcaacagggaccaggtggtccaggtgctgctgctgctgccgcaggtcgtggtcctggtggctatggacaaggtcagcaaggacccggcggacctggcgcagcagctgccgcggccggtccaggtggttatggacctggacaacaaggacctggagcagcagcagctgcagccgctggatctggccctggtggatatggacctggtcagcaaggaccaggacgttcaggtgcagctgctgcagcagccgcagctggtcgtggtccaggtggatatggtccaggacagcagggcccaggaggccctggtgccgcagcggccgctgccggtcctggtggttatggtccaggccaacaaggtcctggtgcagctgcagcagctagtgctggtcgaggacctggtggatatggtcctggacaacaaggtccgggtggatccggagccgctgctgctgcagccggtagaggtcccggtggatacggtccgggtcaacaaggtccaggtggtcctggagctgctgctgcagctgccgctggccgtggtccaggtggctacggaccaggtcaacaaggccctggtcagcagggtcctggaggaagcggtgctgcggctgccgccgctggtcgtggccctggcggatacggtccaggtcaacagggaccaggtggtccaggtgctgctgctgctgccgcaggtcgtggtcctggtggctatggacaaggtcagcaaggacccggcggacctggcgcagcagctgccgcggccggtccaggtggttatggacctggacaacaaggacctggagcagcagcagctgcagccgctggatctggccctggtggatatggacctggtcagcaaggaccaggacgttcaggtgcagctgctgcagcagccgcagctggtcgtggtccaggtggatatggtccaggacagcagggcccaggaggccctggtgccgcagcggccgctgccggtcctggtggttatggtccaggccaacaaggtcctggtgcagctgcagcagctagtgctggtcgaggacctggtggatatggtcctggacaacaaggtccgggtggatccggagccgctgctgctgcagccggtagaggtcccggtggatacggtccgggtcaacaaggtccaggtggtcctggagctgctgctgcagctgccgctggccgtggtccaggtggctacggaccaggtcaacaaggccctggtcagcagggtcctggaggaagcggtgctgcggctgccgccgctggtcgtggccctggcggatacggtccaggtcaacagggaccaggtggtccaggtgctgctgctgctgccgcaggtgactacaaagatgacgacgataaagattacaaagacgatgacgataaggactataaagatgatgacgacaaataataa

SEQ ID NO: 2772 - DNA, 3036 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtcctggaggttatggtcctggtcaacaaaggccaggacaacagggccctggaggtccaggagccgctgccgctgcagcaggtcgcggtcctggaggatatggtcctggacagcaaggccctggaggtcctggtgccgctgcggcagctgcagccggaaggggacctggtggatacggacctggacaacaaggacctggtcaacaaggtccaggcggttcaggtgctgcagcagctgcagctggccgaggacccggcggatatggaccaggtcagcagggaccaggaggacctggcgccgctgccgctgctgcaggacctggaggatacggaccaggacaacaaggtcctggtgctgctgctgccgccgctgcagcaggaagaggaccgggtggatatggaccgggacaacaaggtccaggaggaccaggagcggcagcggctgcagcagctggaagaggccctggcggttatggtcccggtcagcaaggacctggtcagcagggtccaggtggtccgggtgccgctgcagcagcagccggacctggtggttatggaccgggtcaacaaggtaccggagctgctgctgctgcggctgccggttcgggagctggtggatatggaccaggacagcaaggtcctggaggccctggagcagctgcagcagctgcaggtcctggaggttatggtcctggtcaacaaaggccaggacaacagggccctggaggtccaggagccgctgccgctgcagcaggtcgcggtcctggaggatatggtcctggacagcaaggccctggaggtcctggtgccgctgcggcagctgcagccggaaggggacctggtggatacggacctggacaacaaggacctggtcaacaaggtccaggcggttcaggtgctgcagcagctgcagctggccgaggacccggcggatatggaccaggtcagcagggaccaggaggacctggcgccgctgccgctgctgcaggacctggaggatacggaccaggacaacaaggtcctggtgctgctgctgccgccgctgcagcaggaagaggaccgggtggatatggaccgggacaacaaggtccaggaggaccaggagcggcagcggctgcagcagctggaagaggccctggcggttatggtcccggtcagcaaggacctggtcagcagggtccaggtggtccgggtgccgctgcagcagcagccggacctggtggttatggaccgggtcaacaaggtaccggagctgctgctgctgcggctgccggttcgggagctggtggatatggaccaggacagcaaggtcctggaggccctggagcagctgcagcagctgcaggtcctggaggttatggtcctggtcaacaaaggccaggacaacagggccctggaggtccaggagccgctgccgctgcagcaggtcgcggtcctggaggatatggtcctggacagcaaggccctggaggtcctggtgccgctgcggcagctgcagccggaaggggacctggtggatacggacctggacaacaaggacctggtcaacaaggtccaggcggttcaggtgctgcagcagctgcagctggccgaggacccggcggatatggaccaggtcagcagggaccaggaggacctggcgccgctgccgctgctgcaggacctggaggatacggaccaggacaacaaggtcctggtgctgctgctgccgccgctgcagcaggaagaggaccgggtggatatggaccgggacaacaaggtccaggaggaccaggagcggcagcggctgcagcagctggaagaggccctggcggttatggtcccggtcagcaaggacctggtcagcagggtccaggtggtccgggtgccgctgcagcagcagccggacctggtggttatggaccgggtcaacaaggtaccggagctgctgctgctgcggctgccggttcgggagctggtggatatggaccaggacagcaaggtcctggaggccctggagcagctgcagcagctgcaggtcctggaggttatggtcctggtcaacaaaggccaggacaacagggccctggaggtccaggagccgctgccgctgcagcaggtcgcggtcctggaggatatggtcctggacagcaaggccctggaggtcctggtgccgctgcggcagctgcagccggaaggggacctggtggatacggacctggacaacaaggacctggtcaacaaggtccaggcggttcaggtgctgcagcagctgcagctggccgaggacccggcggatatggaccaggtcagcagggaccaggaggacctggcgccgctgccgctgctgcaggacctggaggatacggaccaggacaacaaggtcctggtgctgctgctgccgccgctgcagcaggaagaggaccgggtggatatggaccgggacaacaaggtccaggaggaccaggagcggcagcggctgcagcagctggaagaggccctggcggttatggtcccggtcagcaaggacctggtcagcagggtccaggtggtccgggtgccgctgcagcagcagccggacctggtggttatggaccgggtcaacaaggtaccggagctgctgctgctgcggctgccggttcgggagctggtggatatggaccaggacagcaaggtcctggaggccctggagcagctgcagcagctgcaggtgactacaaagatgacgacgataaagattacaaagacgatgacgataaggactataaagatgatgacgacaaataataa

SEQ ID NO: 2773 - DNA, 2592 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggttcaggaccgggaggttatggtccaggtcaacagggacccggtcgatctggtgctgcagcagcggctgcagctgcaggcagaggtcccggtggatatggtccaggccagcaaggacctggtggtcctggtgccgcagctgctgccgcaggaccaggtggttatggacctggccaacaaggtccaggtgctgccgccgctgcttcagccggtagaggaccgggtggttacggaccaggtcagcagggacctggaggttcaggtgcagctgcagcagctgctggacgtggccctggaggttatggaccaggacagcaaggcccaggcggaccaggagcagctgctgctgccgctgctggtactggaccaggaggatatggtccaggtcagcaaggtcctggaggctccggtgctgctgccgcagcggctggtaggggtccaggtggttacggacctggacaacaaggaccaggtggtcctggagctgcagcggctgcggctggcccaggaggatatggaccaggtcaacaaggacctggcgctgctgctgctgcggcagcaggttcaggaccgggaggttatggtccaggtcaacagggacccggtcgatctggtgctgcagcagcggctgcagctgcaggcagaggtcccggtggatatggtccaggccagcaaggacctggtggtcctggtgccgcagctgctgccgcaggaccaggtggttatggacctggccaacaaggtccaggtgctgccgccgctgcttcagccggtagaggaccgggtggttacggaccaggtcagcagggacctggaggttcaggtgcagctgcagcagctgctggacgtggccctggaggttatggaccaggacagcaaggcccaggcggaccaggagcagctgctgctgccgctgctggtactggaccaggaggatatggtccaggtcagcaaggtcctggaggctccggtgctgctgccgcagcggctggtaggggtccaggtggttacggacctggacaacaaggaccaggtggtcctggagctgcagcggctgcggctggcccaggaggatatggaccaggtcaacaaggacctggcgctgctgctgctgcggcagcaggttcaggaccgggaggttatggtccaggtcaacagggacccggtcgatctggtgctgcagcagcggctgcagctgcaggcagaggtcccggtggatatggtccaggccagcaaggacctggtggtcctggtgccgcagctgctgccgcaggaccaggtggttatggacctggccaacaaggtccaggtgctgccgccgctgcttcagccggtagaggaccgggtggttacggaccaggtcagcagggacctggaggttcaggtgcagctgcagcagctgctggacgtggccctggaggttatggaccaggacagcaaggcccaggcggaccaggagcagctgctgctgccgctgctggtactggaccaggaggatatggtccaggtcagcaaggtcctggaggctccggtgctgctgccgcagcggctggtaggggtccaggtggttacggacctggacaacaaggaccaggtggtcctggagctgcagcggctgcggctggcccaggaggatatggaccaggtcaacaaggacctggcgctgctgctgctgcggcagcaggttcaggaccgggaggttatggtccaggtcaacagggacccggtcgatctggtgctgcagcagcggctgcagctgcaggcagaggtcccggtggatatggtccaggccagcaaggacctggtggtcctggtgccgcagctgctgccgcaggaccaggtggttatggacctggccaacaaggtccaggtgctgccgccgctgcttcagccggtagaggaccgggtggttacggaccaggtcagcagggacctggaggttcaggtgcagctgcagcagctgctggacgtggccctggaggttatggaccaggacagcaaggcccaggcggaccaggagcagctgctgctgccgctgctggtactggaccaggaggatatggtccaggtcagcaaggtcctggaggctccggtgctgctgccgcagcggctggtaggggtccaggtggttacggacctggacaacaaggaccaggtggtcctggagctgcagcggctgcggctggcccaggaggatatggaccaggtcaacaaggacctggcgctgctgctgctgcggcagcaggtgactacaaagatgacgacgataaagattacaaagacgatgacgataaggactataaagatgatgacgacaaataataa

SEQ ID NO: 2774 - DNA, 2436 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtagcggaccaggaggttacggaccaggccaacagggaccaggtggaccgggcgctgcagccgccgccgctggaagaggaccaggtggttatggtcctggtcagcagggaccaggtggtccaggtgcggccgctgctgctgccgcaggacgaggacctggaggatacggtcctggccagcaaggacctggtggttccggtgctgccgctgccgctagtggtaggggtccaggtggtagtggtcctggtggatacggtcccggtcaacagggaccaggagcagccgctgctgctgctgctgcaggtagaggtcctggaggttacggacctggtcagcaaggacctggaggtccaggtgctgccgctgctgccgcagccggtagaggtccgggaggatatggtcctggacaacaaggtcctggtggttctggagccgccgctgctgccgctggaagaggtcctggtggctatggtcccggtcaacaaggacctggcggacctggtgctgcagctgccgcagcaggtagcggaccaggaggttacggaccaggccaacagggaccaggtggaccgggcgctgcagccgccgccgctggaagaggaccaggtggttatggtcctggtcagcagggaccaggtggtccaggtgcggccgctgctgctgccgcaggacgaggacctggaggatacggtcctggccagcaaggacctggtggttccggtgctgccgctgccgctagtggtaggggtccaggtggtagtggtcctggtggatacggtcccggtcaacagggaccaggagcagccgctgctgctgctgctgcaggtagaggtcctggaggttacggacctggtcagcaaggacctggaggtccaggtgctgccgctgctgccgcagccggtagaggtccgggaggatatggtcctggacaacaaggtcctggtggttctggagccgccgctgctgccgctggaagaggtcctggtggctatggtcccggtcaacaaggacctggcggacctggtgctgcagctgccgcagcaggtagcggaccaggaggttacggaccaggccaacagggaccaggtggaccgggcgctgcagccgccgccgctggaagaggaccaggtggttatggtcctggtcagcagggaccaggtggtccaggtgcggccgctgctgctgccgcaggacgaggacctggaggatacggtcctggccagcaaggacctggtggttccggtgctgccgctgccgctagtggtaggggtccaggtggtagtggtcctggtggatacggtcccggtcaacagggaccaggagcagccgctgctgctgctgctgcaggtagaggtcctggaggttacggacctggtcagcaaggacctggaggtccaggtgctgccgctgctgccgcagccggtagaggtccgggaggatatggtcctggacaacaaggtcctggtggttctggagccgccgctgctgccgctggaagaggtcctggtggctatggtcccggtcaacaaggacctggcggacctggtgctgcagctgccgcagcaggtagcggaccaggaggttacggaccaggccaacagggaccaggtggaccgggcgctgcagccgccgccgctggaagaggaccaggtggttatggtcctggtcagcagggaccaggtggtccaggtgcggccgctgctgctgccgcaggacgaggacctggaggatacggtcctggccagcaaggacctggtggttccggtgctgccgctgccgctagtggtaggggtccaggtggtagtggtcctggtggatacggtcccggtcaacagggaccaggagcagccgctgctgctgctgctgcaggtagaggtcctggaggttacggacctggtcagcaaggacctggaggtccaggtgctgccgctgctgccgcagccggtagaggtccgggaggatatggtcctggacaacaaggtcctggtggttctggagccgccgctgctgccgctggaagaggtcctggtggctatggtcccggtcaacaaggacctggcggacctggtgctgcagctgccgcagcaggtgactacaaagatgacgacgataaagattacaaagacgatgacgataaggactataaagatgatgacgacaaataataa

SEQ ID NO: 2775 - DNA, 2220 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtccaggaggttatggtcccggtcaacaaggtcctggagccgctgccgctgcagcaggtagaggacctggcggctatggacctggacaacagggcccaggcggttctggagctgccgcagctgccgcgggaagaggtccaggtggttatggtccaggacaacaaggacctggtggtcctggagctgccgctgcagctgcaggtcccggcggatacggaccaggacagcagggtaccggtgctgctgctgccgcggccgctggttctggtgccggtggttatggtcctggtcaacaaggaccaggaggtcctggagctgctgctgcagctgctggaccgggtggctatggaccaggccagcaaggccctggtgccgccgccgctgctgccgcaggtagtggcccaggcggttatggtccaggtcaacagggacctggtggacctggtgctgctgccgcagcagctgcaggtccaggaggttatggtcccggtcaacaaggtcctggagccgctgccgctgcagcaggtagaggacctggcggctatggacctggacaacagggcccaggcggttctggagctgccgcagctgccgcgggaagaggtccaggtggttatggtccaggacaacaaggacctggtggtcctggagctgccgctgcagctgcaggtcccggcggatacggaccaggacagcagggtaccggtgctgctgctgccgcggccgctggttctggtgccggtggttatggtcctggtcaacaaggaccaggaggtcctggagctgctgctgcagctgctggaccgggtggctatggaccaggccagcaaggccctggtgccgccgccgctgctgccgcaggtagtggcccaggcggttatggtccaggtcaacagggacctggtggacctggtgctgctgccgcagcagctgcaggtccaggaggttatggtcccggtcaacaaggtcctggagccgctgccgctgcagcaggtagaggacctggcggctatggacctggacaacagggcccaggcggttctggagctgccgcagctgccgcgggaagaggtccaggtggttatggtccaggacaacaaggacctggtggtcctggagctgccgctgcagctgcaggtcccggcggatacggaccaggacagcagggtaccggtgctgctgctgccgcggccgctggttctggtgccggtggttatggtcctggtcaacaaggaccaggaggtcctggagctgctgctgcagctgctggaccgggtggctatggaccaggccagcaaggccctggtgccgccgccgctgctgccgcaggtagtggcccaggcggttatggtccaggtcaacagggacctggtggacctggtgctgctgccgcagcagctgcaggtccaggaggttatggtcccggtcaacaaggtcctggagccgctgccgctgcagcaggtagaggacctggcggctatggacctggacaacagggcccaggcggttctggagctgccgcagctgccgcgggaagaggtccaggtggttatggtccaggacaacaaggacctggtggtcctggagctgccgctgcagctgcaggtcccggcggatacggaccaggacagcagggtaccggtgctgctgctgccgcggccgctggttctggtgccggtggttatggtcctggtcaacaaggaccaggaggtcctggagctgctgctgcagctgctggaccgggtggctatggaccaggccagcaaggccctggtgccgccgccgctgctgccgcaggtagtggcccaggcggttatggtccaggtcaacagggacctggtggacctggtgctgctgccgcagcagctgcaggtgactacaaagatgacgacgataaagattacaaagacgatgacgataaggactataaagatgatgacgacaaataataa

SEQ ID NO: 2776 - DNA, 2124 bp, Artificial Sequence
  Description of Artificial Sequence: Synthetic polynucleotide
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtggctacggtcctggtagcggtcagcaaggcccaggcgctggtcaacaaggtcctggtgcaggacagcagggaccatatggaccatctgctgcagcagcagcggctgctgctggcggttacggccctggaggagctggtcagcagggaccaggtgccggtcaacaaggacctggatcacagggtcagtccggtcctggtgccactgtcgctgctgctgctgccggaggatatggcccaggtggtgccggacagcaaggtcctggagctggacaacaaggtcagggatctcaaggaccttatggaccagcggctaccgccgctgccgctgctgctggtggttacggaccaggaagtggccagcaaggtccaggagccggtcaacaaggtccaggaggacaaggaccatatggtccatctgccgctgcagctgctgctgccgcaggtggctacggtcctggtagcggtcagcaaggcccaggcgctggtcaacaaggtcctggtgcaggacagcagggaccatatggaccatctgctgcagcagcagcggctgctgctggcggttacggccctggaggagctggtcagcagggaccaggtgccggtcaacaaggacctggatcacagggtcagtccggtcctggtgccactgtcgctgctgctgctgccggaggatatggcccaggtggtgccggacagcaaggtcctggagctggacaacaaggtcagggatctcaaggaccttatggaccagcggctaccgccgctgccgctgctgctggtggttacggaccaggaagtggccagcaaggtccaggagccggtcaacaaggtccaggaggacaaggaccatatggtccatctgccgctgcagctgctgctgccgcaggtggctacggtcctggtagcggtcagcaaggcccaggcgctggtcaacaaggtcctggtgcaggacagcagggaccatatggaccatctgctgcagcagcagcggctgctgctggcggttacggccctggaggagctggtcagcagggaccaggtgccggtcaacaaggacctggatcacagggtcagtccggtcctggtgccactgtcgctgctgctgctgccggaggatatggcccaggtggtgccggacagcaaggtcctggagctggacaacaaggtcagggatctcaaggaccttatggaccagcggctaccgccgctgccgctgctgctggtggttacggaccaggaagtggccagcaaggtccaggagccggtcaacaaggtccaggaggacaaggaccatatggtccatctgccgctgcagctgctgctgccgcaggtggctacggtcctggtagcggtcagcaaggcccaggcgctggtcaacaaggtcctggtgcaggacagcagggaccatatggaccatctgctgcagcagcagcggctgctgctggcggttacggccctggaggagctggtcagcagggaccaggtgccggtcaacaaggacctggatcacagggtcagtccggtcctggtgccactgtcgctgctgctgctgccggaggatatggcccaggtggtgccggacagcaaggtcctggagctggacaacaaggtcagggatctcaaggaccttatggaccagcggctaccgccgctgccgctgctgctggtggttacggaccaggaagtggccagcaaggtccaggagccggtcaacaaggtccaggaggacaaggaccatatggtccatctgccgctgcagctgctgctgccgcaggtgactacaaagatgacgacgataaagattacaaagacgatgacgataaggactataaagatgatgacgacaaataataa

SEQ ID NO: 2777 - protein, 986 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGGYGPGAGQQGPGGAGQQGPGSQGPGGAGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGLGPYGPSAAAAAAAAGGYGPGAGQQGPGSQGPGSGGQQRPGGLGPYGPSAAAAAAAAGGYGPGAGQQGPGSQGPGSGGQQRPGGLGPYGPSAAAAAAAAGGYGPGAGQQGPGGAGQQGPGSQGPGGAGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGLGPYGPSAAAAAAAAGGYGPGAGQQGPGSQGPGSGGQQRPGGLGPYGPSAAAAAAAAGGYGPGAGQQGPGSQGPGSGGQQRPGGLGPYGPSAAAAAAAAGGYGPGAGQQGPGGAGQQGPGSQGPGGAGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGLGPYGPSAAAAAAAAGGYGPGAGQQGPGSQGPGSGGQQRPGGLGPYGPSAAAAAAAAGGYGPGAGQQGPGSQGPGSGGQQRPGGLGPYGPSAAAAAAAAGGYGPGAGQQGPGGAGQQGPGSQGPGGAGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGLGPYGPSAAAAAAAAGGYGPGAGQQGPGSQGPGSGGQQRPGGLGPYGPSAAAAAAAAGGYGPGAGQQGPGSQGPGSGGQQRPGGLGPYGPSAAAAAAAAGDYKDDDDKDYKDDDDKDYKDDDDK

SEQ ID NO: 2778 - protein, 1226 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGSAPQGAGGPAPQGPSQQGPVSQGPYGPGAAAAAAAAGGYGPGAGQQGPGSQGPGSGGQQGPGSQGPGSGGQQGPGGQGPYGPSAAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGSAPQGAGGPAPQGPSQQGPVSQGPYGPGAAAAAAAAGGYGPGAGQQGPGSQGPGSGGQQGPGSQGPGSGGQQGPGGQGPYGPSAAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGSAPQGAGGPAPQGPSQQGPVSQGPYGPGAAAAAAAAGGYGPGAGQQGPGSQGPGSGGQQGPGSQGPGSGGQQGPGGQGPYGPSAAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGSAPQGAGGPAPQGPSQQGPVSQGPYGPGAAAAAAAAGGYGPGAGQQGPGSQGPGSGGQQGPGSQGPGSGGQQGPGGQGPYGPSAAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGDYKDDDDKDYKDDDDKDYKDDDDK

SEQ ID NO: 2779 - protein, 1118 aa, Artificial Sequence; identical to SEQ ID NO: 1435
  Description of Artificial Sequence: Synthetic polypeptide

SEQ ID NO: 2780 - protein, 1026 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQRSQGPGGQGPYGPGAGQQGPGSQGPGSGGQQGPGGQGPYGPSAAAAAAAAGPGAGRQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQRSQGPGGQGPYGPGAGQQGPGSQGPGSGGQQGPGGQGPYGPSAAAAAAAAGPGAGRQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQRSQGPGGQGPYGPGAGQQGPGSQGPGSGGQQGPGGQGPYGPSAAAAAAAAGPGAGRQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQRSQGPGGQGPYGPGAGQQGPGSQGPGSGGQQGPGGQGPYGPSAAAAAAAAGPGAGRQGPGSQGPGSGGQQGPGGQGPYGPSAAAAAAAAGDYKDDDDKDYKDDDDKDYKDDDDK

SEQ ID NO: 2781 - protein, 1142 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGPGARRQGPGSQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGPGARRQGPGSQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGPGARRQGPGSQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGPGARRQGPGSQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGDYKDDDDKDYKDDDDKDYKDDDDK

SEQ ID NO: 2782 - protein, 1134 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGGYGPGAGQQGPGSGGQQGPGGQGPYGSGQQGPGGAGQQGPGGQGPYGPGAAAAAAAAAGGYGPGAGQQGPGGAGQQGPEGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGGYGPGAGQQGPGSGGQQGPGGQGPYGSGQQGPGGAGQQGPGGQGPYGPGAAAAAAAAAGGYGPGAGQQGPGGAGQQGPEGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGGYGPGAGQQGPGSGGQQGPGGQGPYGSGQQGPGGAGQQGPGGQGPYGPGAAAAAAAAAGGYGPGAGQQGPGGAGQQGPEGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGGYGPGAGQQGPGSGGQQGPGGQGPYGSGQQGPGGAGQQGPGGQGPYGPGAAAAAAAAAGGYGPGAGQQGPGGAGQQGPEGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGDYKDDDDKDYKDDDDKDYKDDDDK

SEQ ID NO: 2783 - protein, 1122 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGGYGPGAGQQGPGGAGQQGPGSQGPGGQGPYGPGAGQQGPGSQGPGSGGQQGPGGQGPYGPSAAAAAAAAGGYGPGAGQQGPGSQGPGSGGQQGPGSQGPGSGGQQGPGGQGPYGPSAAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGGAGQQGPGSQGPGGQGPYGPGAGQQGPGSQGPGSGGQQGPGGQGPYGPSAAAAAAAAGGYGPGAGQQGPGSQGPGSGGQQGPGSQGPGSGGQQGPGGQGPYGPSAAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGGAGQQGPGSQGPGGQGPYGPGAGQQGPGSQGPGSGGQQGPGGQGPYGPSAAAAAAAAGGYGPGAGQQGPGSQGPGSGGQQGPGSQGPGSGGQQGPGGQGPYGPSAAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGGAGQQGPGSQGPGGQGPYGPGAGQQGPGSQGPGSGGQQGPGGQGPYGPSAAAAAAAAGGYGPGAGQQGPGSQGPGSGGQQGPGSQGPGSGGQQGPGGQGPYGPSAAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGDYKDDDDKDYKDDDDKDYKDDDDK

SEQ ID NO: 2784 - protein, 1158 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAGGYGPGAGQQGPGSQGPGSGGQQGPGGQGPYGPSAAAAAAAAGGYGPGAGQQGPGSGGQQGPGGQGPYGSGQQGPGGAGQQGPGGQGPYGGGYGPGAGQQGPGSQGPGSGGQQGPGGQGPYGPSAAAAAAAAGDYKDDDDKDYKDDDDKDYKDDDDK

SEQ ID NO: 2785 - protein, 1146 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGPGARRQGPGSQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGPGARRQGPGSQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGPGARRQGPGSQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGPGARRQGPGSQGPGSGGQQGPGGQGPYGSGQQGPGGAGQQGPGGQGPYGPGAAAAAAAAAGGYGPGAGQQGPGGAGQQGPGSQGPGGQGPYGPGAGQQGPGSQGPGSGGQQGPGGQGPYGPSAAAAAAAAAGGYGPGAGQQGPGSQGPGSGGQQGPGGQGPYGPGAAAAAAAVGGYGPGAGQQGPGSQGPGSGGQQGPGGQGPYGPSAAAAAAAAGGYGPGAGQQGPGSQGPGSGGQQGPGGQGPYGPSAAAAAAAAGDYKDDDDKDYKDDDDKDYKDDDDK

SEQ ID NO: 2786 - protein, 674 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGPGYGPGAGQQGPGSGGQQGGPGSGQQGPGGAGQGGPRGQGPYGPGAAAAAAAAAGGYGPGAGQQGPGSQGPGSGGQQGPGSQGPYGPSAAAAAAAAGPGYGPGAGQQGPGSQGPGSGGQQGPGGQGPYGPSAAAAAAAAGPGYGPGAGQQGPGSGGQQGGPGSGQQGPGGAGQGGPRGQGPYGPGAAAAAAAAAGGYGPGAGQQGPGSQGPGSGGQQGPGSQGPYGPSAAAAAAAAGPGYGPGAGQQGPGSQGPGSGGQQGPGGQGPYGPSAAAAAAAAGPGYGPGAGQQGPGSGGQQGGPGSGQQGPGGAGQGGPRGQGPYGPGAAAAAAAAAGGYGPGAGQQGPGSQGPGSGGQQGPGSQGPYGPSAAAAAAAAGPGYGPGAGQQGPGSQGPGSGGQQGPGGQGPYGPSAAAAAAAAGPGYGPGAGQQGPGSGGQQGGPGSGQQGPGGAGQGGPRGQGPYGPGAAAAAAAAAGGYGPGAGQQGPGSQGPGSGGQQGPGSQGPYGPSAAAAAAAAGPGYGPGAGQQGPGSQGPGSGGQQGPGGQGPYGPSAAAAAAAAGDYKDDDDKDYKDDDDKDYKDDDDK

SEQ ID NO: 2787 - protein, 674 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGPGYGPGAGQQGPGSGGQQGGQGSGQQGPGGAGQGGPRGQGPYGPGAAAAAAAAAGGYGPGAGQQGPGSQGPGSGGQQGPGSQGPYGPSAAAAAAAAGPGYGPGAGQQGPGSQGPGSGGQQGPGGQGPYGPSAAAAAAAAGPGYGPGAGQQGPGSGGQQGGQGSGQQGPGGAGQGGPRGQGPYGPGAAAAAAAAAGGYGPGAGQQGPGSQGPGSGGQQGPGSQGPYGPSAAAAAAAAGPGYGPGAGQQGPGSQGPGSGGQQGPGGQGPYGPSAAAAAAAAGPGYGPGAGQQGPGSGGQQGGQGSGQQGPGGAGQGGPRGQGPYGPGAAAAAAAAAGGYGPGAGQQGPGSQGPGSGGQQGPGSQGPYGPSAAAAAAAAGPGYGPGAGQQGPGSQGPGSGGQQGPGGQGPYGPSAAAAAAAAGPGYGPGAGQQGPGSGGQQGGQGSGQQGPGGAGQGGPRGQGPYGPGAAAAAAAAAGGYGPGAGQQGPGSQGPGSGGQQGPGSQGPYGPSAAAAAAAAGPGYGPGAGQQGPGSQGPGSGGQQGPGGQGPYGPSAAAAAAAAGDYKDDDDKDYKDDDDKDYKDDDDK

SEQ ID NO: 2788 - protein, 670 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGPGYGPGAGQQGPGSGGQQGGQGSGQQGPGGAGQGGPRGQGPYGPGAAAAAAAAGGYGPGAGQQGPGSQGPGSGGQQGPGSQGPYGPSAAAAAAAAGPGYGPGAGQQGPGSQGPGSGGQQGPGSQGPYGPSAAAAAAAAGPGYGPGAGQQGPGSGGQQGGQGSGQQGPGGAGQGGPRGQGPYGPGAAAAAAAAGGYGPGAGQQGPGSQGPGSGGQQGPGSQGPYGPSAAAAAAAAGPGYGPGAGQQGPGSQGPGSGGQQGPGSQGPYGPSAAAAAAAAGPGYGPGAGQQGPGSGGQQGGQGSGQQGPGGAGQGGPRGQGPYGPGAAAAAAAAGGYGPGAGQQGPGSQGPGSGGQQGPGSQGPYGPSAAAAAAAAGPGYGPGAGQQGPGSQGPGSGGQQGPGSQGPYGPSAAAAAAAAGPGYGPGAGQQGPGSGGQQGGQGSGQQGPGGAGQGGPRGQGPYGPGAAAAAAAAGGYGPGAGQQGPGSQGPGSGGQQGPGSQGPYGPSAAAAAAAAGPGYGPGAGQQGPGSQGPGSGGQQGPGSQGPYGPSAAAAAAAAGDYKDDDDKDYKDDDDKDYKDDDDK

SEQ ID NO: 2789 - protein, 1058 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGPGGYGGPGQQGPGQGQQQGPASAAAAAAAAGPGGYGGPGQQGPGQGQQQGPASAAAAAAAAAGPGGYGGPGQQRPGQAQYGRGTGQQGQGPGAQQGPASAAAAAAAGAGLYGGPGQQGPGQGQQQGPASAAAAAAAAAAAGPGGYGGPGQQGPGQAQQQGPASAAAAAAAGPGGYSGPGQQGPGQAQQQGPASAAAAAAAAAGPGGYGGPGQQGPGQGQQQGPASAAAAAAATAAGPGGYGGPGQQGPGQGQQQGPASAAAAAAAAGPGGYGGPGQQGPGQGQQQGPASAAAAAAAAAGPGGYGGPGQQRPGQAQYGRGTGQQGQGPGAQQGPASAAAAAAAGAGLYGGPGQQGPGQGQQQGPASAAAAAAAAAAAGPGGYGGPGQQGPGQAQQQGPASAAAAAAAGPGGYSGPGQQGPGQAQQQGPASAAAAAAAAAGPGGYGGPGQQGPGQGQQQGPASAAAAAAATAAGPGGYGGPGQQGPGQGQQQGPASAAAAAAAAGPGGYGGPGQQGPGQGQQQGPASAAAAAAAAAGPGGYGGPGQQRPGQAQYGRGTGQQGQGPGAQQGPASAAAAAAAGAGLYGGPGQQGPGQGQQQGPASAAAAAAAAAAAGPGGYGGPGQQGPGQAQQQGPASAAAAAAAGPGGYSGPGQQGPGQAQQQGPASAAAAAAAAAGPGGYGGPGQQGPGQGQQQGPASAAAAAAATAAGPGGYGGPGQQGPGQGQQQGPASAAAAAAAAGPGGYGGPGQQGPGQGQQQGPASAAAAAAAAAGPGGYGGPGQQRPGQAQYGRGTGQQGQGPGAQQGPASAAAAAAAGAGLYGGPGQQGPGQGQQQGPASAAAAAAAAAAAGPGGYGGPGQQGPGQAQQQGPASAAAAAAAGPGGYSGPGQQGPGQAQQQGPASAAAAAAAAAGPGGYGGPGQQGPGQGQQQGPASAAAAAAATAAGDYKDDDDKDYKDDDDKDYKDDDDK

SEQ ID NO: 2790 - protein, 1026 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGPGGYGGPGQQGPGQGQYGPGTGQQGQGPSGQQGPAGAAAAAAAAAGPGGYGGPGQQGPGQGQYGPGAGQQGQGPGGQQGPAGAAAAAAAAAGPGGYGGPGQQGPGQGQQQGRAGAAAAAAAGPGGYGGPGQQGPGQAQQQGPAAAASAGPGGYGGPGQQGPGQGQQKGPASAAAAAAATAAGPGGYGGPGQQGPGQGQYGPGTGQQGQGPGGQQGPASAAAAAAAAAGPGGYGGPGQQGPGQGQYGPGTGQQGQGPSGQQGPAGAAAAAAAAAGPGGYGGPGQQGPGQGQYGPGAGQQGQGPGGQQGPAGAAAAAAAAAGPGGYGGPGQQGPGQGQQQGRAGAAAAAAAGPGGYGGPGQQGPGQAQQQGPAAAASAGPGGYGGPGQQGPGQGQQKGPASAAAAAAATAAGPGGYGGPGQQGPGQGQYGPGTGQQGQGPGGQQGPASAAAAAAAAAGPGGYGGPGQQGPGQGQYGPGTGQQGQGPSGQQGPAGAAAAAAAAAGPGGYGGPGQQGPGQGQYGPGAGQQGQGPGGQQGPAGAAAAAAAAAGPGGYGGPGQQGPGQGQQQGRAGAAAAAAAGPGGYGGPGQQGPGQAQQQGPAAAASAGPGGYGGPGQQGPGQGQQKGPASAAAAAAATAAGPGGYGGPGQQGPGQGQYGPGTGQQGQGPGGQQGPASAAAAAAAAAGPGGYGGPGQQGPGQGQYGPGTGQQGQGPSGQQGPAGAAAAAAAAAGPGGYGGPGQQGPGQGQYGPGAGQQGQGPGGQQGPAGAAAAAAAAAGPGGYGGPGQQGPGQGQQQGRAGAAAAAAAGPGGYGGPGQQGPGQAQQQGPAAAASAGPGGYGGPGQQGPGQGQQKGPASAAAAAAATAAGPGGYGGPGQQGPGQGQYGPGTGQQGQGPGGQQGPASAAAAAAAAAGDYKDDDDKDYKDDDDKDYKDDDDK

SEQ ID NO: 2791 - protein, 1090 aa, Artificial Sequence; identical to SEQ ID NO: 1439
  Description of Artificial Sequence: Synthetic polypeptide

SEQ ID NO: 2792 - protein, 1030 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGPGGYGGPGQQGPGQGQYGPGTGQQGQGPGGQQGPVGAAAAAAAAVSSGGYGSQGAGQGGQQGSGQRGPAAAGPGGYSGPGQQGPGQGGQQGPASAAAAAAAAAGPGGYGGSGQQGPGQGRGTGQQGQGPGGQQGPASAAAAAAAGPGGYGGPGQQGPGQGQYGPGTGQQGQGPASAAAAAAAGPGGYGGPGQQGPGQGQYGPGTGQQGQGPGGQQGPGGASAAAAAAAGPGGYGGPGQQGPGQGQYGPGTGQQGQGPGGQQGPVGAAAAAAAAVSSGGYGSQGAGQGGQQGSGQRGPAAAGPGGYSGPGQQGPGQGGQQGPASAAAAAAAAAGPGGYGGSGQQGPGQGRGTGQQGQGPGGQQGPASAAAAAAAGPGGYGGPGQQGPGQGQYGPGTGQQGQGPASAAAAAAAGPGGYGGPGQQGPGQGQYGPGTGQQGQGPGGQQGPGGASAAAAAAAGPGGYGGPGQQGPGQGQYGPGTGQQGQGPGGQQGPVGAAAAAAAAVSSGGYGSQGAGQGGQQGSGQRGPAAAGPGGYSGPGQQGPGQGGQQGPASAAAAAAAAAGPGGYGGSGQQGPGQGRGTGQQGQGPGGQQGPASAAAAAAAGPGGYGGPGQQGPGQGQYGPGTGQQGQGPASAAAAAAAGPGGYGGPGQQGPGQGQYGPGTGQQGQGPGGQQGPGGASAAAAAAAGPGGYGGPGQQGPGQGQYGPGTGQQGQGPGGQQGPVGAAAAAAAAVSSGGYGSQGAGQGGQQGSGQRGPAAAGPGGYSGPGQQGPGQGGQQGPASAAAAAAAAAGPGGYGGSGQQGPGQGRGTGQQGQGPGGQQGPASAAAAAAAGPGGYGGPGQQGPGQGQYGPGTGQQGQGPASAAAAAAAGPGGYGGPGQQGPGQGQYGPGTGQQGQGPGGQQGPGGASAAAAAAAGDYKDDDDKDYKDDDDKDYKDDDDK

SEQ ID NO: 2793 - protein, 978 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGPGGYGPGQQGPGGYGPGQQGPGRYGPGQQGPSGPGSAAAAAAGSGQQGPGGYGPRQQGPGGYGQGQQGPSGPGSAAAASAAASAESGQQGPGGYGPGQQGPGGYGPGQQGPGGYGPGQQGPSGPGSAAAAAAAASGPGQQGPGGYGPGQQGPGGYGPGQQGPSGPGSAAAAAAAASGPGQQGPGGYGPGQQGPGGYGPGQQGLSGPGSAAAAAAAGPGGYGPGQQGPGGYGPGQQGPGRYGPGQQGPSGPGSAAAAAAGSGQQGPGGYGPRQQGPGGYGQGQQGPSGPGSAAAASAAASAESGQQGPGGYGPGQQGPGGYGPGQQGPGGYGPGQQGPSGPGSAAAAAAAASGPGQQGPGGYGPGQQGPGGYGPGQQGPSGPGSAAAAAAAASGPGQQGPGGYGPGQQGPGGYGPGQQGLSGPGSAAAAAAAGPGGYGPGQQGPGGYGPGQQGPGRYGPGQQGPSGPGSAAAAAAGSGQQGPGGYGPRQQGPGGYGQGQQGPSGPGSAAAASAAASAESGQQGPGGYGPGQQGPGGYGPGQQGPGGYGPGQQGPSGPGSAAAAAAAASGPGQQGPGGYGPGQQGPGGYGPGQQGPSGPGSAAAAAAAASGPGQQGPGGYGPGQQGPGGYGPGQQGLSGPGSAAAAAAAGPGGYGPGQQGPGGYGPGQQGPGRYGPGQQGPSGPGSAAAAAAGSGQQGPGGYGPRQQGPGGYGQGQQGPSGPGSAAAASAAASAESGQQGPGGYGPGQQGPGGYGPGQQGPGGYGPGQQGPSGPGSAAAAAAAASGPGQQGPGGYGPGQQGPGGYGPGQQGPSGPGSAAAAAAAASGPGQQGPGGYGPGQQGPGGYGPGQQGLSGPGSAAAAAAAGDYKDDDDKDYKDDDDKDYKDDDDK

SEQ ID NO: 2794 - protein, 1014 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGRGPGGYGPGQQGPGGPGAAAAAAGPGGYGPGGYGPGQQGPGGPGAAAAAAAGRGPGGYGPGQQGPGQQGPGGSGAAAAAAGRGPGGYGPGQQGPGGPGAAAAAAGPGGYGPGQQGPGAAAAAAAAGRGPGGYGPGQQGPGGPGAAAAAAAGRGPGGYGPGQQGPGQQGPGGSGAAAAAAGRGPGGYGPGQQGPGGPGAAAAAAGPGGYGPGQQGPGAAAAAAAAGRGPGGYGPGQQGPGGPGAAAAAAGPGGYGPGGYGPGQQGPGGPGAAAAAAAGRGPGGYGPGQQGPGQQGPGGSGAAAAAAGRGPGGYGPGQQGPGGPGAAAAAAGPGGYGPGQQGPGAAAAAAAAGRGPGGYGPGQQGPGGPGAAAAAAAGRGPGGYGPGQQGPGQQGPGGSGAAAAAAGRGPGGYGPGQQGPGGPGAAAAAAGPGGYGPGQQGPGAAAAAAAAGRGPGGYGPGQQGPGGPGAAAAAAGPGGYGPGGYGPGQQGPGGPGAAAAAAAGRGPGGYGPGQQGPGQQGPGGSGAAAAAAGRGPGGYGPGQQGPGGPGAAAAAAGPGGYGPGQQGPGAAAAAAAAGRGPGGYGPGQQGPGGPGAAAAAAAGRGPGGYGPGQQGPGQQGPGGSGAAAAAAGRGPGGYGPGQQGPGGPGAAAAAAGPGGYGPGQQGPGAAAAAAAAGRGPGGYGPGQQGPGGPGAAAAAAGPGGYGPGGYGPGQQGPGGPGAAAAAAAGRGPGGYGPGQQGPGQQGPGGSGAAAAAAGRGPGGYGPGQQGPGGPGAAAAAAGPGGYGPGQQGPGAAAAAAAAGRGPGGYGPGQQGPGGPGAAAAAAAGRGPGGYGPGQQGPGQQGPGGSGAAAAAAGRGPGGYGPGQQGPGGPGAAAAAAGPGGYGPGQQGPGAAAAAAAAGDYKDDDDKDYKDDDDKDYKDDDDK

SEQ ID NO: 2795 - protein, 1014 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGRGPGGYGPGQQGPGGSGAAAAAAGRGPGGYGPGQQGPGGPGAAAAAAGPGGYGPGQQGTGAAAAAAAGSGAGGYGPGQQGPGGPGAAAAAAGPGGYGPGQQGPGAAAAAAAGSGPGGYGPGQQGPGGSSAAAAAAGPGRYGPGQQGPGAAAAASAGRGPGGYGPGQQGPGGPGAAAAAAGPGGYGPGQQGPGAAAAAAAGSGPGGYGPGQQGPGGPGAAAAAAAGRGPGGYGPGQQGPGGSGAAAAAAGRGPGGYGPGQQGPGGPGAAAAAAGPGGYGPGQQGTGAAAAAAAGSGAGGYGPGQQGPGGPGAAAAAAGPGGYGPGQQGPGAAAAAAAGSGPGGYGPGQQGPGGSSAAAAAAGPGRYGPGQQGPGAAAAASAGRGPGGYGPGQQGPGGPGAAAAAAGPGGYGPGQQGPGAAAAAAAGSGPGGYGPGQQGPGGPGAAAAAAAGRGPGGYGPGQQGPGGSGAAAAAAGRGPGGYGPGQQGPGGPGAAAAAAGPGGYGPGQQGTGAAAAAAAGSGAGGYGPGQQGPGGPGAAAAAAGPGGYGPGQQGPGAAAAAAAGSGPGGYGPGQQGPGGSSAAAAAAGPGRYGPGQQGPGAAAAASAGRGPGGYGPGQQGPGGPGAAAAAAGPGGYGPGQQGPGAAAAAAAGSGPGGYGPGQQGPGGPGAAAAAAAGRGPGGYGPGQQGPGGSGAAAAAAGRGPGGYGPGQQGPGGPGAAAAAAGPGGYGPGQQGTGAAAAAAAGSGAGGYGPGQQGPGGPGAAAAAAGPGGYGPGQQGPGAAAAAAAGSGPGGYGPGQQGPGGSSAAAAAAGPGRYGPGQQGPGAAAAASAGRGPGGYGPGQQGPGGPGAAAAAAGPGGYGPGQQGPGAAAAAAAGSGPGGYGPGQQGPGGPGAAAAAAAGDYKDDDDKDYKDDDDKDYKDDDDK

SEQ ID NO: 2796 - protein, 978 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGRGPGGYGQGQQGPGGPGAAAAAAGPGGYGPGQQGPGAAAAAAAGSGPGGYGPGQQGPGRSGAAAAAAAAGRGPGGYGPGQQGPGGPGAAAAAAGPGGYGPGQQGPGAAAAASAGRGPGGYGPGQQGPGGSGAAAAAAGRGPGGYGPGQQGPGGPGAAAAAAAGRGPGGYGPGQQGPGQQGPGGSGAAAAAAGRGPGGYGPGQQGPGGPGAAAAAAGRGPGGYGQGQQGPGGPGAAAAAAGPGGYGPGQQGPGAAAAAAAGSGPGGYGPGQQGPGRSGAAAAAAAAGRGPGGYGPGQQGPGGPGAAAAAAGPGGYGPGQQGPGAAAAASAGRGPGGYGPGQQGPGGSGAAAAAAGRGPGGYGPGQQGPGGPGAAAAAAAGRGPGGYGPGQQGPGQQGPGGSGAAAAAAGRGPGGYGPGQQGPGGPGAAAAAAGRGPGGYGQGQQGPGGPGAAAAAAGPGGYGPGQQGPGAAAAAAAGSGPGGYGPGQQGPGRSGAAAAAAAAGRGPGGYGPGQQGPGGPGAAAAAAGPGGYGPGQQGPGAAAAASAGRGPGGYGPGQQGPGGSGAAAAAAGRGPGGYGPGQQGPGGPGAAAAAAAGRGPGGYGPGQQGPGQQGPGGSGAAAAAAGRGPGGYGPGQQGPGGPGAAAAAAGRGPGGYGQGQQGPGGPGAAAAAAGPGGYGPGQQGPGAAAAAAAGSGPGGYGPGQQGPGRSGAAAAAAAAGRGPGGYGPGQQGPGGPGAAAAAAGPGGYGPGQQGPGAAAAASAGRGPGGYGPGQQGPGGSGAAAAAAGRGPGGYGPGQQGPGGPGAAAAAAAGRGPGGYGPGQQGPGQQGPGGSGAAAAAAGRGPGGYGPGQQGPGGPGAAAAAAGDYKDDDDKDYKDDDDKDYKDDDDK

SEQ ID NO: 2797 - protein, 1010 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGPGGYGPGQQRPGQQGPGGPGAAAAAAGRGPGGYGPGQQGPGGPGAAAAAAAGRGPGGYGPGQQGPGQQGPGGSGAAAAAAGRGPGGYGPGQQGPGGPGAAAAAAGPGGYGPGQQGPGAAAAAAAAGRGPGGYGPGQQGPGGPGAAAAAAAGRGPGGYGPGQQGPGQQGPGGPGAAAAAAGPGGYGPGQQGTGAAAAAAAGSGAGGYGPGQQGPGGPGAAAAAAGPGGYGPGQQRPGQQGPGGPGAAAAAAGRGPGGYGPGQQGPGGPGAAAAAAAGRGPGGYGPGQQGPGQQGPGGSGAAAAAAGRGPGGYGPGQQGPGGPGAAAAAAGPGGYGPGQQGPGAAAAAAAAGRGPGGYGPGQQGPGGPGAAAAAAAGRGPGGYGPGQQGPGQQGPGGPGAAAAAAGPGGYGPGQQGTGAAAAAAAGSGAGGYGPGQQGPGGPGAAAAAAGPGGYGPGQQRPGQQGPGGPGAAAAAAGRGPGGYGPGQQGPGGPGAAAAAAAGRGPGGYGPGQQGPGQQGPGGSGAAAAAAGRGPGGYGPGQQGPGGPGAAAAAAGPGGYGPGQQGPGAAAAAAAAGRGPGGYGPGQQGPGGPGAAAAAAAGRGPGGYGPGQQGPGQQGPGGPGAAAAAAGPGGYGPGQQGTGAAAAAAAGSGAGGYGPGQQGPGGPGAAAAAAGPGGYGPGQQRPGQQGPGGPGAAAAAAGRGPGGYGPGQQGPGGPGAAAAAAAGRGPGGYGPGQQGPGQQGPGGSGAAAAAAGRGPGGYGPGQQGPGGPGAAAAAAGPGGYGPGQQGPGAAAAAAAAGRGPGGYGPGQQGPGGPGAAAAAAAGRGPGGYGPGQQGPGQQGPGGPGAAAAAAGPGGYGPGQQGTGAAAAAAAGSGAGGYGPGQQGPGGPGAAAAAAGDYKDDDDKDYKDDDDKDYKDDDDK

SEQ ID NO: 2798 - protein, 862 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGSGPGGYGPGQQGPGRSGAAAAAAAAGRGPGGYGPGQQGPGGPGAAAAAAGPGGYGPGQQGPGAAAAASAGRGPGGYGPGQQGPGGSGAAAAAAGRGPGGYGPGQQGPGGPGAAAAAAAGTGPGGYGPGQQGPGGSGAAAAAAGRGPGGYGPGQQGPGGPGAAAAAAGPGGYGPGQQGPGAAAAAAAGSGPGGYGPGQQGPGRSGAAAAAAAAGRGPGGYGPGQQGPGGPGAAAAAAGPGGYGPGQQGPGAAAAASAGRGPGGYGPGQQGPGGSGAAAAAAGRGPGGYGPGQQGPGGPGAAAAAAAGTGPGGYGPGQQGPGGSGAAAAAAGRGPGGYGPGQQGPGGPGAAAAAAGPGGYGPGQQGPGAAAAAAAGSGPGGYGPGQQGPGRSGAAAAAAAAGRGPGGYGPGQQGPGGPGAAAAAAGPGGYGPGQQGPGAAAAASAGRGPGGYGPGQQGPGGSGAAAAAAGRGPGGYGPGQQGPGGPGAAAAAAAGTGPGGYGPGQQGPGGSGAAAAAAGRGPGGYGPGQQGPGGPGAAAAAAGPGGYGPGQQGPGAAAAAAAGSGPGGYGPGQQGPGRSGAAAAAAAAGRGPGGYGPGQQGPGGPGAAAAAAGPGGYGPGQQGPGAAAAASAGRGPGGYGPGQQGPGGSGAAAAAAGRGPGGYGPGQQGPGGPGAAAAAAAGTGPGGYGPGQQGPGGSGAAAAAAGRGPGGYGPGQQGPGGPGAAAAAAGPGGYGPGQQGPGAAAAAAAGDYKDDDDKDYKDDDDKDYKDDDDK

SEQ ID NO: 2799 - protein, 810 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGSGPGGYGPGQQGPGGPGAAAAAAGRGPGGYGPGQQGPGGPGAAAAAAAGRGPGGYGPGQQGPGGSGAAAAASGRGPGGSGPGGYGPGQQGPGAAAAAAAAGRGPGGYGPGQQGPGGPGAAAAAAAGRGPGGYGPGQQGPGGSGAAAAAAGRGPGGYGPGQQGPGGPGAAAAAAGSGPGGYGPGQQGPGGPGAAAAAAGRGPGGYGPGQQGPGGPGAAAAAAAGRGPGGYGPGQQGPGGSGAAAAASGRGPGGSGPGGYGPGQQGPGAAAAAAAAGRGPGGYGPGQQGPGGPGAAAAAAAGRGPGGYGPGQQGPGGSGAAAAAAGRGPGGYGPGQQGPGGPGAAAAAAGSGPGGYGPGQQGPGGPGAAAAAAGRGPGGYGPGQQGPGGPGAAAAAAAGRGPGGYGPGQQGPGGSGAAAAASGRGPGGSGPGGYGPGQQGPGAAAAAAAAGRGPGGYGPGQQGPGGPGAAAAAAAGRGPGGYGPGQQGPGGSGAAAAAAGRGPGGYGPGQQGPGGPGAAAAAAGSGPGGYGPGQQGPGGPGAAAAAAGRGPGGYGPGQQGPGGPGAAAAAAAGRGPGGYGPGQQGPGGSGAAAAASGRGPGGSGPGGYGPGQQGPGAAAAAAAAGRGPGGYGPGQQGPGGPGAAAAAAAGRGPGGYGPGQQGPGGSGAAAAAAGRGPGGYGPGQQGPGGPGAAAAAAGDYKDDDDKDYKDDDDKDYKDDDDK

SEQ ID NO: 2800 - protein, 738 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGPGGYGPGQQGPGAAAAAAGRGPGGYGPGQQGPGGSGAAAAAAGRGPGGYGPGQQGPGGPGAAAAAAGPGGYGPGQQGTGAAAAAAAGSGAGGYGPGQQGPGGPGAAAAAAGPGGYGPGQQGPGAAAAAAAGSGPGGYGPGQQGPGGPGAAAAAAAGPGGYGPGQQGPGAAAAAAGRGPGGYGPGQQGPGGSGAAAAAAGRGPGGYGPGQQGPGGPGAAAAAAGPGGYGPGQQGTGAAAAAAAGSGAGGYGPGQQGPGGPGAAAAAAGPGGYGPGQQGPGAAAAAAAGSGPGGYGPGQQGPGGPGAAAAAAAGPGGYGPGQQGPGAAAAAAGRGPGGYGPGQQGPGGSGAAAAAAGRGPGGYGPGQQGPGGPGAAAAAAGPGGYGPGQQGTGAAAAAAAGSGAGGYGPGQQGPGGPGAAAAAAGPGGYGPGQQGPGAAAAAAAGSGPGGYGPGQQGPGGPGAAAAAAAGPGGYGPGQQGPGAAAAAAGRGPGGYGPGQQGPGGSGAAAAAAGRGPGGYGPGQQGPGGPGAAAAAAGPGGYGPGQQGTGAAAAAAAGSGAGGYGPGQQGPGGPGAAAAAAGPGGYGPGQQGPGAAAAAAAGSGPGGYGPGQQGPGGPGAAAAAAAGDYKDDDDKDYKDDDDKDYKDDDDK

SEQ ID NO: 2801 - protein, 706 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAEAGGYGPGSGQQGPGAGQQGPGAGQQGPYGPSAAAAAAAAGGYGPGGAGQQGPGAGQQGPGSQGQSGPGATVAAAAAGGYGPGGAGQQGPGAGQQGQGSQGPYGPAATAAAAAAGGYGPGSGQQGPGAGQQGPGGQGPYGPSAAAAAAAAGGYGPGSGQQGPGAGQQGPGAGQQGPYGPSAAAAAAAAGGYGPGGAGQQGPGAGQQGPGSQGQSGPGATVAAAAAGGYGPGGAGQQGPGAGQQGQGSQGPYGPAATAAAAAAGGYGPGSGQQGPGAGQQGPGGQGPYGPSAAAAAAAAGGYGPGSGQQGPGAGQQGPGAGQQGPYGPSAAAAAAAAGGYGPGGAGQQGPGAGQQGPGSQGQSGPGATVAAAAAGGYGPGGAGQQGPGAGQQGQGSQGPYGPAATAAAAAAGGYGPGSGQQGPGAGQQGPGGQGPYGPSAAAAAAAAGGYGPGSGQQGPGAGQQGPGAGQQGPYGPSAAAAAAAAGGYGPGGAGQQGPGAGQQGPGSQGQSGPGATVAAAAAGGYGPGGAGQQGPGAGQQGQGSQGPYGPAATAAAAAAGGYGPGSGQQGPGAGQQGPGGQGPYGPSAAAAAAAAGDYKDDDDKDYKDDDDKDYKDDDDK

SEQ ID NO: 2802 - DNA, 2688 bp, Artificial Sequence
  Description of Artificial Sequence: Synthetic polynucleotide
gaaacgatgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagcaggtgcaggttacacgggaccatccggcccatcgactggtccatccggttacccaggtcctctaggtggtggagctccatttggacaaagtggcttcggaggtagtgatggtcctcaaggcggttttggtgccaccggtggtgctagcgctggtttaatctcacgagttgctaacgctttggccaacacttccacactaagaactgtacttagaactggagtgtctcaacagatagcaagtagtgttgtccagagagcagcacaatctcttgctagtactttaggcgttgacggcaataatctcgccagattcgcagttcaagcagtttccagattgcccgctggatctgatacttcagcatacgcacaggcattcagtagcgccctgtttaatgccggtgtgttgaatgccagtaacatcgacaccctaggtagtagagtcctgtccgctttactaaacggtgtaagctcagctgctcaaggtttgggcatcaacgtggattctggttctgttcaaagtgatatttcgtcatcttcaagtttcttgtctaccagcagctcctcggcttcttactctcaagctagtgccagttctacttcaggtgcaggttacacgggaccatccggcccatcgactggtccatccggttacccaggtcctctaggtggtggagctccatttggacaaagtggcttcggaggtagtgatggtcctcaaggcggttttggtgccaccggtggtgctagcgctggtttaatctcacgagttgctaacgctttggccaacacttccacactaagaactgtacttagaactggagtgtctcaacagatagcaagtagtgttgtccagagagcagcacaatctcttgctagtactttaggcgttgacggcaataatctcgccagattcgcagttcaagcagtttccagattgcccgctggatctgatacttcagcatacgcacaggcattcagtagcgccctgtttaatgccggtgtgttgaatgccagtaacatcgacaccctaggtagtagagtcctgtccgctttactaaacggtgtaagctcagctgctcaaggtttgggcatcaacgtggattctggttctgttcaaagtgatatttcgtcatcttcaagtttcttgtctaccagcagctcctcggcttcttactctcaagctagtgccagttctacttcaggtttcaccggagcaagctatcccggtccacaagtctcacagcctgcacctttcggcgtcggcccacaaccaggaggtgctctacctggttttggacaagtatctggagctcaaagtgcccttatttctagaatcgccaacgctttgggtaacaccgctactatgcgagctgtcttgcgcagcggagtgagtcaacaaattgtctcaaatgttgttcaaggagctgtgcaggcattatcatccagtctgggaattgatggtaataacttggcaaggattgcttctcagaccatactcagagtacctgctggttcggacactagcgcatacgctcaagcattttctactgccctgttcaattcgggtgttttgaacgctagtaatgtgaacacattgggctcccaggtggtatcgacgttgctgcgtggcatctcatcaacggcacaaggtcttggattaaacgtcgacgcaggttccgttcaatccgatataagttctagtagttcctttctgtctacttcctcgtcctccacctcatcttcacaaacaactgcagcaagtacgtcaggtttcaccggagcaagctatcccggtccacaagtctcacagcctgcacctttcggcgtcggcccacaaccaggaggtgctctacctggttttggacaagtatctggagctcaaagtgcccttatttctagaatcgccaacgctttgggtaacaccgctactatgcgagctgtcttgcgcagcggagtgagtcaacaaattgtctcaaatgttgttcaaggagctgtgcaggcattatcatccagtctgggaattgatggtaataacttggcaaggattgcttctcagaccatactcagagtacctgctggttcggacactagcgcatacgctcaagcattttctactgccctgttcaattcgggtgttttgaacgctagtaatgtgaacacattgggctcccaggtggtatcgacgttgctgcgtggcatctcatcaacggcacaaggtcttggattaaacgtcgacgcaggttccgttcaatccgatataagttctagtagttcctttctgtctacttcctcgtcctccacctcatcttcacaaacaactgcagcaagtacgtcaggtgactacaaagatgacgacgataaagattacaaagacgatgacgataaggactataaagatgatgacgacaaataataa

SEQ ID NO: 2803 - protein, 5 aa, Artificial Sequence
  Description of Artificial Sequence: Synthetic peptide
AAAAA

SEQ ID NO: 2804 - protein, 5 aa, Artificial Sequence
  Description of Artificial Sequence: Synthetic peptide
SGAGG

SEQ ID NO: 2805 - protein, 5 aa, Artificial Sequence
  Description of Artificial Sequence: Synthetic peptide
GSGAG

SEQ ID NO: 2806 - protein, 5 aa, Artificial Sequence
  Description of Artificial Sequence: Synthetic peptide
GGSGA

SEQ ID NO: 2807 - protein, 181 aa, Aliatypus gulosus; identical to SEQ ID NO: 1077

SEQ ID NO: 2808 - protein, 126 aa, Plectreurys tristis; identical to SEQ ID NO: 1574

SEQ ID NO: 2809 - protein, 239 aa, Plectreurys tristis; identical to SEQ ID NO: 1142

SEQ ID NO: 2810 - protein, 182 aa, Araneus gemmoides; identical to SEQ ID NO: 1150

SEQ ID NO: 2811 - protein, 180 aa, Argiope aurantia; identical to SEQ ID NO: 1158

SEQ ID NO: 2812 - protein, 199 aa, Deinopis spinosa; identical to SEQ ID NO: 1192

SEQ ID NO: 2813 - protein, 171 aa, Nephila clavipes; identical to SEQ ID NO: 1210

SEQ ID NO: 2814 - protein, 268 aa, Argiope trifasciata; identical to SEQ ID NO: 1252

SEQ ID NO: 2815 - protein, 420 aa, Nephila clavipes; identical to SEQ ID NO: 1733

SEQ ID NO: 2816 - protein, 376 aa, Latrodectus hesperus; identical to SEQ ID NO: 1751

SEQ ID NO: 2817 - protein, 200 aa, Argiope trifasciata; identical to SEQ ID NO: 1296

SEQ ID NO: 2818 - protein, 357 aa, Uloborus diversus; identical to SEQ ID NO: 1774

SEQ ID NO: 2819 - protein, 32 aa, Euprosthenops australis; identical to SEQ ID NO: 1941

SEQ ID NO: 2820 - protein, 42 aa, Tetragnatha kauaiensis; identical to SEQ ID NO: 2149

SEQ ID NO: 2821 - protein, 42 aa, Argiope aurantia; identical to SEQ ID NO: 1799

SEQ ID NO: 2822 - protein, 46 aa, Deinopis spinosa; identical to SEQ ID NO: 1866

SEQ ID NO: 2823 - protein, 42 aa, Nephila clavata; identical to SEQ ID NO: 2008

SEQ ID NO: 2824 - protein, 8 aa, Artificial Sequence
  Description of Artificial Sequence: Synthetic peptide
  misc_feature (1)..(8): This sequence may encompass 6-8 repeating residues wherein some positions may be absent
HHHHHHHH

SEQ ID NO: 2825 - DNA, 12 bp, Artificial Sequence
  Description of Artificial Sequence: Synthetic oligonucleotide
gaagacttagca

SEQ ID NO: 2826 - DNA, 11 bp, Artificial Sequence
  Description of Artificial Sequence: Synthetic oligonucleotide
ggtacgtcttc

SEQ ID NO: 2827 - DNA, 30 bp, Artificial Sequence
  Description of Artificial Sequence: Synthetic primer
ctaagaggcgcgcctaagcgatggtctcaa

SEQ ID NO: 2828 - DNA, 33 bp, Artificial Sequence
  Description of Artificial Sequence: Synthetic primer
tgcatcggacgtcctatcgctacttctgcatgg

SEQ ID NO: 2829 - DNA, 49 bp, Artificial Sequence
  Description of Artificial Sequence: Synthetic primer
ctaagaggcgcgcctaagcgatggtctcaaggtgcaggtgcaagggctg

SEQ ID NO: 2830 - DNA, 50 bp, Artificial Sequence
  Description of Artificial Sequence: Synthetic primer
tgcatcggacgtcctatcgctacttctgcatggaggccgtatccgcggat

SEQ ID NO: 2831 - DNA, 60 bp, Artificial Sequence
  Description of Artificial Sequence: Synthetic primer
aagacgatgacgataaggactataaagatgatgacgacaaataatgcggtagtttatcac

SEQ ID NO: 2832 - DNA, 60 bp, Artificial Sequence
  Description of Artificial Sequence: Synthetic primer
ccagcgcctggaccgtaacccggccgcagcctgcgcagacatgttgctgaacgccatcgt

SEQ ID NO: 2833 - DNA, 10 bp, Artificial Sequence
  Description of Artificial Sequence: Synthetic oligonucleotide
gaagacttaa

SEQ ID NO: 2834 - DNA, 38 bp, Artificial Sequence
  Description of Artificial Sequence: Synthetic primer
ctaagaggtctcacaggtagtcaaggacctggttcagg

SEQ ID NO: 2835 - DNA, 36 bp, Artificial Sequence
  Description of Artificial Sequence: Synthetic primer
ttcagtggtctctaccttgttgtcctccagatccag

SEQ ID NO: 2836 - DNA, 37 bp, Artificial Sequence
  Description of Artificial Sequence: Synthetic primer
ctaagaggtctcacaggtcctggaggtcagggtccat

SEQ ID NO: 2837 - DNA, 41 bp, Artificial Sequence
  Description of Artificial Sequence: Synthetic primer
ttcagtggtctctacctggtccctgttgaccagcaccagga

SEQ ID NO: 2838 - protein, 6 aa, Artificial Sequence
  Description of Artificial Sequence: Synthetic peptide
AAAAAA

SEQ ID NO: 2839 - DNA, 27 bp, Artificial Sequence
  Description of Artificial Sequence: Synthetic oligonucleotide
ggcgcgccttagcgatggtctcaaggt

SEQ ID NO: 2840 - DNA, 28 bp, Artificial Sequence
  Description of Artificial Sequence: Synthetic oligonucleotide
aggtacgtcttcatcgctatcctgcagg

SEQ ID NO: 2841 - DNA, 16 bp, Artificial Sequence
  Description of Artificial Sequence: Synthetic oligonucleotide
gcgatggtctcaaggt

SEQ ID NO: 2842 - DNA, 17 bp, Artificial Sequence
  Description of Artificial Sequence: Synthetic oligonucleotide
aggtacgtcttcatcgc

SEQ ID NO: 2843 - DNA, 19 bp, Artificial Sequence
  Description of Artificial Sequence: Synthetic oligonucleotide
gaagactgacgtcgagacc

What is claimed is:

1. A proteinaceous block co-polymer, comprising:
   a polypeptide, the polypeptide comprising from 2 to 8 concatenated repeats of SEQ ID NO: 1396 or circularly permuted variants thereof.

2. The proteinaceous block co-polymer of claim 1, wherein the polypeptide comprises a property selected from the group consisting of an alanine composition from 12 to 40%, a glycine composition from 25 to 50%, a proline composition from 9 to 20%, a β-turn composition from 15 to 37%, a GPG amino acid motif content from 18 to 55%, and a poly-alanine amino acid motif content from 9 to 35%.

3. The proteinaceous block co-polymer of claim 1, consisting of: 3 concatenated repeats of SEQ ID NO: 1396.

4. A fiber comprising the block co-polymer of claim 1.

5. The fiber of claim 4, comprising a circular cross-section and a diameter from 4.48 to 12.7 μm.

6. The fiber of claim 4, wherein the fiber has a yield stress from 24 to 172 MPa.

7. The fiber of claim 4, wherein the fiber has a maximum stress from 54 to 310 MPa.

8. The fiber of claim 4, wherein the fiber has a breaking strain from 2 to 200%.

9. The fiber of claim 4, wherein the fiber has an initial modulus from 1617 to 5820 MPa.

10. The fiber of claim 4, wherein the fiber has a toughness value from 0.5 MJ/m$^3$ to 59.2 MJ/m$^3$.

11. A culture medium comprising a secreted block copolymer of claim 1.

* * * * *